(12) United States Patent
Seidman et al.

(10) Patent No.: US 9,476,097 B2
(45) Date of Patent: Oct. 25, 2016

(54) STRUCTURAL MUTATIONS IN TITIN CAUSE DILATED CARDIOMYOPATHY

(75) Inventors: Jonathan G. Seidman, Milton, MA (US); Christine E. Seidman, Milton, MA (US); Daniel E. Herman, Cambridge, MA (US)

(73) Assignees: The Brigham and Women's Hospital, Inc., Boston, MA (US); President and Fellows of Harvard College, Cambridge, MA (US)

( * ) Notice: Subject to any disclaimer, the term of this patent is extended or adjusted under 35 U.S.C. 154(b) by 480 days.

(21) Appl. No.: 14/111,308

(22) PCT Filed: Apr. 11, 2012

(86) PCT No.: PCT/US2012/033122
§ 371 (c)(1),
(2), (4) Date: Feb. 24, 2014

(87) PCT Pub. No.: WO2012/142159
PCT Pub. Date: Oct. 18, 2012

(65) Prior Publication Data
US 2014/0199284 A1    Jul. 17, 2014

Related U.S. Application Data

(60) Provisional application No. 61/474,106, filed on Apr. 11, 2011.

(51) Int. Cl.
*C12Q 1/68* (2006.01)
*C12N 9/12* (2006.01)

(52) U.S. Cl.
CPC .............. *C12Q 1/6883* (2013.01); *C12N 9/12* (2013.01); *C12Q 2600/112* (2013.01); *C12Q 2600/156* (2013.01)

(58) Field of Classification Search
None
See application file for complete search history.

(56) References Cited

U.S. PATENT DOCUMENTS

2004/0265841 A1   12/2004 Fishman et al.
2006/0034508 A1    2/2006 Zhou et al.

OTHER PUBLICATIONS

Bang et al. The Complete Gene Sequence of Titin, Expression of an Unusual ~700-kDa Titin Isoform, and Its Interaction With Obscurin Identify a Novel Z-Line to I-Band Linking System. Circulation Research 89:1065-1072; Nov. 1, 2001.*
Bos et al. Genotype-phenotype relationships involving hypertrophic cardiomyopathy-associated mutations in titin, muscle LIM protein, and telethonin. Molecular Genetics and Metabolism 88:78-85; 2006.*
Gerull et al. Identification of a novel frameshift mutation in the giant muscle filament titin in a large Australian family with dilated cardiomyopathy. J. Mol. Med. 84:478-483; 2006.*
Herman et al. Truncations of Titin Causing Dilated Cardiomyopathy. NEJM 366:619-628; 2012.*
Satoh et al. Structural analysis of the Titin gene in hypertrophic cardiomyopathy: Identification of a novel disease gene. BBRC 262:411-417; 1999.*
Satoh et al. Titin mutations as the molecular basis for dilated cardiomyopathy. BBRC 291:385-393; 2002.*
GenBank GI:378925624 [online] Mar. 1, 2012 [retrieved on Mar. 25, 2016] retrieved from: http://www.ncbi.nlm.nih.gov/nuccore/378925624?sat=15&satkey=5726601 (3 pages).*
Gasser et al. Reversal of Borrelia burgdorferi associated dilated cardiomyopathy by antibiotic treatment? Cardiovascular Drugs and Therapy 10:351-360 (1996).*
Gautel, M. The sarcomeric cytoskeleton: who picks up the strain? Current Opinion in Cell Biology 23:39-46 (2011).*
Wu et al. Effect of genome size on AAV vector packaging. Molecular Therapy 18:80-86 (2010).*
Hedman et al. Progress and prospects: hurdles to cardiovascular gene therapy clinical trials. Gene Therapy 18:743-749 (2011).*
Ahmad F. et al., Annu Rev Genomics Hum Genet. 6:185-216 (2005). "The genetic basis for cardiac remodeling.".
Baig M.K., et al., Am Coll Cardiol. 31(1):195-201 (Jan. 1998). "Familial dilated cardiomyopathy: cardiac abnormalities are common in asymptomatic relatives and may represent early disease.".
Dellefave L. et al., Curr Opin Cardiol. 25(3):198-204 (May 2010). doi: 10.1097/HCO.0b013e328337ba52. "The genetics of dilated cardiomyopathy.".
Gerull B. et al., Nat Genet. 30(2):201-204 (Feb. 2002). Epub Jan. 14, 2002 "Mutations of TTN, encoding the giant muscle filament titin, cause familial dilated cardiomyopathy.".
Mestroni L., J Am Coll Cardiol. 34(1):181-190 (Jul. 1999). "Familial dilated cardiomyopathy: evidence for genetic and phenotypic heterogeneity. Heart Muscle Disease Study Group.".
Michels V.V. et al., N. Engl J Med. 326(2):77-82 (Jan. 9, 1992). "The frequency of familial dilated cardiomyopathy in a series of patients with idiopathic dilated cardiomyopathy.".
Zimmerman R.S. et al., Genet Med. 12(5):268-278 (May 2010). doi: 10.1097/GIM.0b013e3181d6f7c0. "A novel custom resequencing array for dilated cardiomyopathy.".

* cited by examiner

*Primary Examiner* — Samuel Woolwine
(74) *Attorney, Agent, or Firm* — Nixon Peabody LLP

(57) ABSTRACT

Provided herein are diagnostic markers and methods for identifying a subject having an increased susceptibility for developing or having dilated cardiomyopathy. The method comprises determining if the subject has a mutation in the TTN nucleic as acid or titin polypeptide. Further provided herein are methods of treating subjects having or at risk of having dilated cardiomyopathy.

6 Claims, 13 Drawing Sheets

STRUCTURAL MUTATIONS IN TITIN CAUSE DILATED CARDIOMYOPATHY

CROSS REFERENCE TO RELATED APPLICATIONS

This application is a 35 U.S.C. §371 National Phase Entry Application of International Application No. PCT/US2012/033122 filed Apr. 11, 2012, which designates the U.S., and which claims benefit under 35 U.S.C. §119(e) of the U.S. Provisional Application No. 61/474,106, filed Apr. 11, 2011, the contents of each of which are incorporated herein by reference in their entireties.

GOVERNMENT SUPPORT

This invention was made with government support under grant no. N01-HV-48194 awarded by the National Heart, Lung, and Blood Institute. The government has certain rights in the invention.

SEQUENCE LISTING

The instant application contains a Sequence Listing which has been submitted in ASCII format via EFS-Web and is hereby incorporated by reference in its entirety. Said ASCII copy, created on Oct. 10, 2013, is named 043214-073012_SL and is 793,523 bytes in size.

TECHNOLOGICAL FIELD

The technology described herein relates to determining if a subject is at increased risk of developing dilated cardiomyopathy. The technology described herein further relates to methods and compositions for treating dilated cardiomyopathy.

BACKGROUND

Gene mutations have been implicated as a cause of cardiomyopathy. For example, variations in over 40 genes, most of which encode components of the sarcomere, the cytoskeleton, or the nuclear lamina, have been demonstrated or posited to cause dilated cardiomyopathy (DCM) (Ahmad et al. Annual review of genomics and human genetics 2005; 6:185-216; Dellefave L, Mcnally E M. Current Opinion in Cardiology 2010; 25(3):198-204). Further, while clinical evaluation identifies affected or likely-affected family members in 30 to 50% of DCM cases (Michels et al. N Engl J Med 1992; 326(2):77-82; Baig et al. Journal of the American College of Cardiology 1998; 31(1):195; Mestroni et al. Journal of the American College of Cardiology 1999; 34(1): 181-90), implicating a genetic etiology, pathogenic mutations have been found in only 20 to 30% of cases (Zimmerman et al. Genet Med 2010; 12(5):268-78).

TTN, the gene encoding titin, has been implicated in cardiomyopathy, but has been incompletely studied due to technical challenges posed by the monumental size of its coding sequence (~100 kb). Titin is the largest human protein (~33,000 amino acids) and the third most abundant striated muscle protein (Trinick et al. J Mol Biol 1984; 180(2):331-56)

SUMMARY

The inventors have discovered inter alia that certain mutations in the TTN gene sequence are associated with an increased risk of having or developing DCM and/or heart failure. Further, the inventors have discovered that certain TTN mutations which result in truncated versions of the titin protein being produced are much more widespread in subjects with DCM as compared to healthy controls as well as control subjects suffering from other forms of cardiomyopathy. Usually, mutations that truncate titin increase the risk of developing DCM and/or heart failure by 100-200 fold. Accordingly, the methods and compositions described herein relate to methods and compositions for determining whether a subject is at increased risk for having or developing DCM as well as for treating a subject determined to have or be at risk of developing DCM.

Accordingly, provided herein is an assay for determining if a subject has an increased risk for developing a dilated cardiomyopathy (DCM) or is in need of treatment to prevent further development of DCM or progression towards DCM. The assay comprises detecting a mutation in the TTN gene, which results in a truncated (shortened) titin polypeptide. Presence of such a mutation in the nucleic acid sample indicates that the subject has an increased risk for developing DCM and/or heart failure.

In some embodiments, detection of the mutation can be by sequencing of a TTN gene derived-nucleic acid. Sequencing of the nucleic acid sample can be carried out using any nucleic acid sequencing known to one of ordinary skill in the art. Exemplary nucleic acid sequencing methods and systems include, but are not limited to, Maxam-Gilbert sequencing, dye-terminator sequencing, Lynx Therapeutics' Massively Parallel Sequencing (MPSS) Polony sequencing, 454 Pyrosequencing, Illumina (Solexa) sequencing, SOLiD™ sequencing, Single Molecule SMART™ sequencing, Single Molecule real time (RNAP) sequencing, Nanaopore DNA sequencing, sequencing by technology from VisiGen Biotechnologies, and the like.

In some embodiments, the mutation is predicted to result in a titin polypeptide lacking or missing part of the pro-band or the A-band region in the individual carrying the mutation.

Also provided herein is a method of treating a subject destined to develop dilated cardiomyopathy and/or heart failure. The method comprises selecting a subject at risk for developing DCM or in need of treatment for DCM or pre-DCM using an assay described herein and administering a treatment for DCM to the subject.

BRIEF DESCRIPTION OF THE DRAWINGS

(FIG. 6A): IGV (Integrated Genomics View) screenshot of ~950 bp of genomic sequence from subject MIV-14. Eight reads are displayed. Among the 188 50-basepair reads aligned at residue chr2:179477886, 98 reads predicted the A/T deletion (Tables 6 and 8). (FIG. 6B) IGV screenshot of aligned sequences derived from RNA sequence of left ventricular tissue. Reads were aligned using TOPHAT. A BAM file of RNA sequences corresponding to genomic region in A is displayed. Ten of 11 sequences show normal RNA splicing. One read (denoted as exon skip) omitted exon 204. Six other reads that were not aligned by TOPHAT (not shown) also indicate abnormal splicing. (FIG. 6C) IGV screenshot of TTN exons and introns in the 950 bp region flanking chr2:179477886. Note that normal splicing (indicated in panel B) includes exon 204. Primers (denoted pF and pR) designed to correspond to sequences in exon 203 and 205 are: pF:CCATCATGTTCTGGTTTTGTCCAAT-TCAACCTTACT (SEQ ID NO: 3) and pR: CAATCACA-GGATACTGGGTTGAAAGACTGGA (SEQ ID NO:4). (FIG. 6D) MIV-14 RNA was RT-PCR amplified using primer pF and pR and size fractionated by gel electrophoresis (3% agarose). Lanes (left to right) are: 50 bp ladder, control A, control B, and MIV14. PCR products corresponding to WT-splicing and MIV-14 exon skip splicing were analyzed by dideoxy sequencing (data not shown).

DETAILED DESCRIPTION

Figure 1:
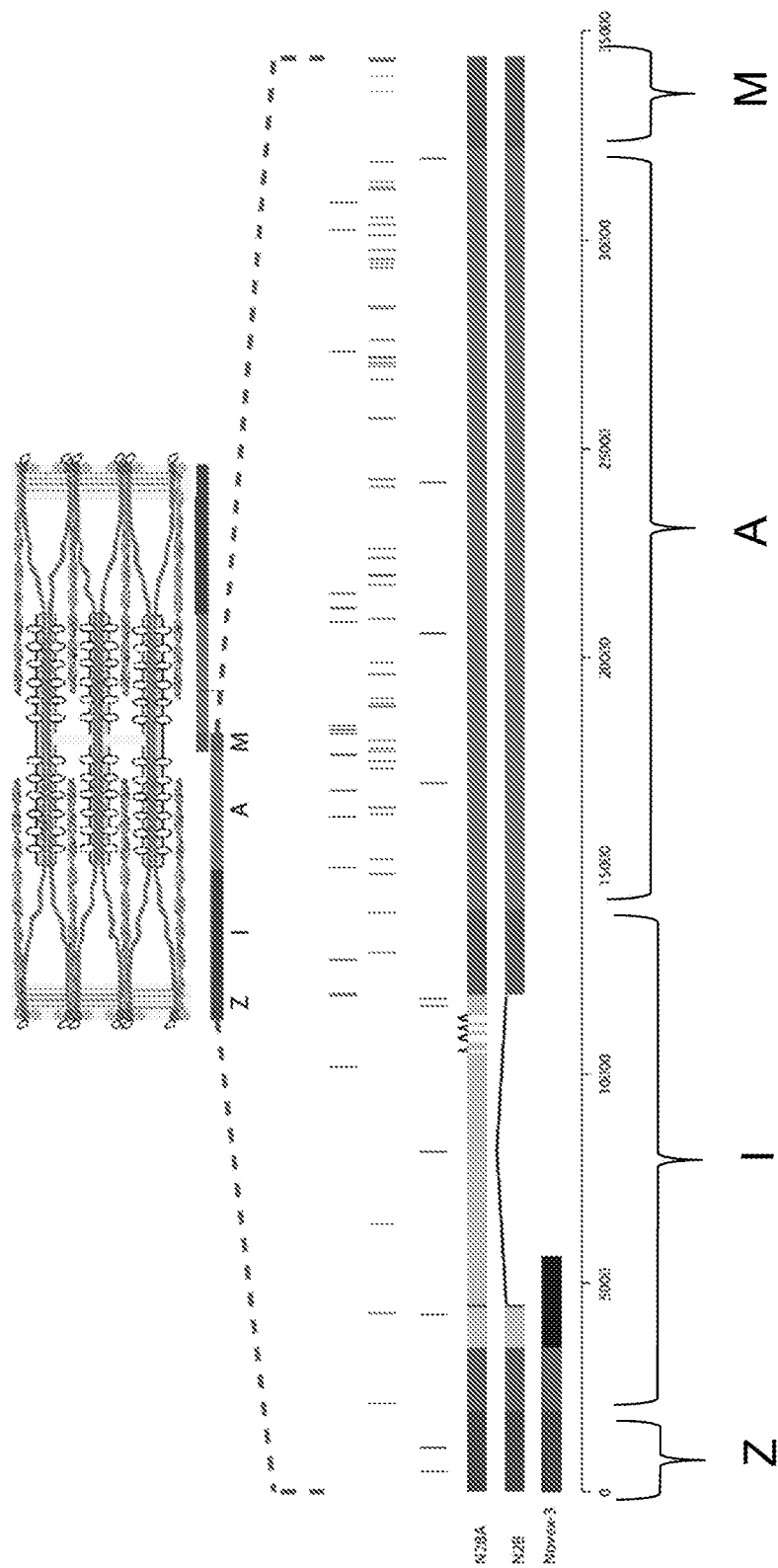
FIG. 1 depicts the spatial distribution of TTN structural mutations. Titin (solid, dark grey lines in left-most portion of the diagram) is the third major filament of the cardiac sarcomere, in addition to the thick and thin (light grey) filaments. The titin protein is linearly depicted with its Z-disk region, I-band region, A-band region, and M-band region demarcated. Titin isoform classes and sequence variants are shown relative to the titin UniProt sequence (Q8WZ42) below. In cardiac tissue, TTN expresses many titin isoforms that span the sarcomere and are classified as N2BA or N2B, as well as the shorter and less abundant novex-3 titin. The exon specific to novex-3 titin is marked (black). The locations of splicing and copy-number mutations (top row of mutation marks) and nonsense and frameshift mutations (middle row of mutation marks, except above the M-band region) identified in DCM subjects, including two frameshift mutations previously reported to be linked to DCM (Table 16), and truncating variants in control and HCM subjects (bottom row of mutation marks) are indicated with vertical bars. Truncation mutations (middle row of mutation marks in the M-band region) previously identified in patients with congenital myopathy (light grey) or limb-girdle muscular dystrophy (dark grey) are also indicated. Overlapping mutations are stacked horizontally and appear as thicker bars.

Described herein are compositions and methods of determining if a subject is at increased risk or in need of treatment to prevent onset of DCM and or heart-failure, based upon the inventors' discovery of a number of mutations in the TTN gene, which are predicted to encode truncated titin proteins in the affected individuals and which cause or will eventually cause DCM and or heart failure. This discovery and further characterization of the mutations is the basis for further methods of treating DCM involving administering a variety of treatments to a subject who, without treatment has >95% chance of developing DCM and/or heart failure. Dilated cardiomyopathy (DCM) is a condition in which part of the heart becomes weakened and enlarged by dilation, resulting in inefficient functioning. Heart failure is a condition heart failure in which the heart is unable to maintain an adequate circulation of blood in the tissues of the body or to pump out the venous blood returned to it by the venous circulation.

The resulting decreased heart function can lead to effects on other organs such as the liver and lungs. DCM is the most common form of non-ischemic cardiomyopathy and causes approximately 30% of congestive heart failure cases.

Methods for diagnosing DCM are well known in the art and include, but are not limited to a magnetic resonance image (MRI) to determine whether the subject's heart is enlarged, an electrocardiogram to detect abnormal electrical activity of the heart, an echocardiogram to determine the size and shape of the heart, a radionuclide ventriculogram to examine heart function, or cardiac catheterization of dyes coupled with the use of x-ray examination to assess cardiac structure and function. A diagnosis of DCM can be made when dilation and increased sphericity of, typically, at least the left ventricle and reduced systolic function are observed. Subjects with DCM can be asymptomatic or can exhibit one or more symptoms associated with DCM, which include, but are not limited to shortness of breath, dyspnoea, fatigue, swelling of the ankles and legs, muscle weakness, dystrophy, syncope, arrhythymia, thromboembolism, and/or congestive heart failure. The diagnosis of DCM is reviewed in more detail, for example, in Taylor et al. Orphanet J Rare Dis 2006 1:27; which is incorporated by reference herein in its entirety. In some embodiments, DCM can be idiopathic.

As used herein, a "subject" means a human or animal. Usually the animal is a vertebrate such as a primate, rodent, domestic animal or game animal. Primates include chimpanzees, cynomologous monkeys, spider monkeys, and macaques, e.g., Rhesus. Rodents include mice, rats, woodchucks, ferrets, rabbits and hamsters. Domestic and game animals include cows, horses, pigs, deer, bison, buffalo, feline species, e.g., domestic cat, canine species, e.g., dog, fox, wolf, avian species, e.g., chicken, emu, ostrich, and fish, e.g., trout, catfish and salmon. Patient or subject includes any subset of the foregoing, e.g., all of the above, but excluding one or more groups or species such as humans, primates or rodents. In certain embodiments, the subject is a mammal, e.g., a primate, e.g., a human. The terms, "patient", "individual" and "subject" are used interchangeably herein. Preferably, the subject is a mammal. The mammal can be a human, non-human primate, mouse, rat, dog, cat, horse, or cow, but are not limited to these examples. Mammals other than humans can be advantageously used, for example, as subjects that represent animal models of, for example, DCM. In addition, the methods described herein can be used to treat domesticated animals and/or pets. A subject can be male or female.

A subject can be one who has been previously diagnosed with or identified as suffering from or having DCM or one or more complications related to DCM, and optionally, but need not have already undergone treatment for DCM or the one or more complications related to DCM. A subject can be one who has not been previously diagnosed as having DCM or one or more complications related to DCM. For example, a subject can be one who exhibits one or more risk factors for DCM or one or more complications related to DCM or a subject who does not exhibit risk factors or a subject who is a family member of an individual who has been diagnosed with a cardiac condition.

A subject at risk of having or developing DCM can be identified by any means known in the art, including the present methods described herein. Thus, for example, a subject at risk can be identified by a family history of DCM, signs or symptoms of DCM, or by having one or more risk factors for DCM. Risk factors for DCM include, but are not limited to, prior instances of myocardial infarction, infection with coxsacki B virus or enteroviruses, autoimmune disease, alcohol abuse, chemotherapy (particularly doxorubicin and cobalt), thyroid disease, tachycardia, stimulant use, extrasystole, and pregnancy. A subject in need of treatment for DCM can be a subject having or diagnosed as having DCM, a subject at risk for developing DCM, or a subject displaying signs and/or symptoms of DCM.

In some embodiments, a subject in need of treatment for DCM or at risk of developing DCM can be asymptomatic.

Accordingly, provided herein is a method of treating a subject for dilated cardiomyopathy and/or heart failure. The method comprises selecting a subject at risk for developing DCM or in need of treatment for DCM or pre-DCM using an assay described herein and administering a treatment for DCM to the subject.

In some embodiments, the methods and compositions described herein relate to determining if a subject is at increased risk of having or developing DCM. A subject is at increased risk if they are at least 10% more likely, to develop DCM, a symptom of DCM, or a condition associated with DCM as compared to the average risk or a the risk for a reference of developing DCM, a symptom of DCM, or a condition associated with DCM. The average risk of developing DCM, a symptom of DCM, or a condition associated with DCM can be the likelihood of a subject in a population which does not display risk factors for DCM (e.g. family history of DCM) of developing DCM a symptom of DCM, or a condition associated with DCM. In some embodiments, the reference can be a normal healthy subject with no genetic susceptibility for DCM. For example, a normal healthy subject is not a carrier of any of the TTN mutations described herein or is not diagnosed with any forms DCM or cardiomyopathy. The reference can be also a control sample, a pooled sample of control individuals or a numeric value or range of values based on the same.

In one aspect, the methods and compositions described herein relate to determining the presence of a TTN nucleic acid mutation in a sample obtained from a subject. TTN (NCBI Gene ID: 7273) is a gene encoding the large protein titin, which contributes to the elasticity of muscle tissue. In some embodiments, the methods and compositions described herein relate to determining the presence of a TTN nucleic acid mutation, which results in a truncated (shortened) TITIN polypeptide, in a sample obtained from a subject. Without limitations, sequencing of the nucleic acid sample can be carried out using any nucleic acid sequencing known to one of ordinary skill in the art. Presence of such a mutation can indicate an increased risk of having or developing DCM. TTN nucleic acid mutations, which result in a truncated TITIN polypeptide are also referred to as DCM-risk associated TTN mutations herein.

In some embodiments, the mutation results in a titin polypeptide lacking or missing part of the pro-band or the A-band region, i.e., the truncated TITIN polypeptide lacks part of the A-band, having a wild-type sequence set forth in SEQ ID NO: 725

In some embodiments, the sample can be obtained from a fetus using methods known in the art. This can be helpful in prenatal diagnosis of DCM when a family member has been diagnosed or is at risk of developing DCM or one or more complications related to DCM, or a cardiac condition.

In some embodiments, the presence of one or more of the TTN mutations described herein can indicate an increased risk of having or developing DCM. In some embodiments, the DCM-risk associated TTN mutation can be any of the following mutations: 6247_6247delG, 12745C>T, 14470_14471insCACACTCCATA (SEQ ID NO: 722), 19183_19183delG, 23798_23810delGTCAAGATATCTG (SEQ ID NO: 723), 38621_38622insA, 44336_44336delA, 45322_45322delT, 49077G>A, 51883C>T, 52408C>T, 53145_53146insG, 53347G>T, 53935_53935delC, 56367T>A, 56572C>T, 56953C>T, 58678C>T, 59530C>T, 61046_61046delC, 65867_65867delA, 67057_67063delG-CATATGinsTA, 67745_67745delT, 72178_72179insT, 72723_72739delinsAGA, 77065C>T, 79896G>A, 80845C>T, 81046A>T, 81440G>A, 81536_81537delCT, 82701C>A, 84977_84980delATTA, 87953G>A, 88242C>T, 88528G>T, 89177_89181delAAATT, 90241C>T, 91042_91042delA, 91537_91538insA, 94111A>T, 95522C>A, 30476-1G>A, 34186+1G>T, 35635G>C, 35635+1G>A, 44725+2delT, 48364+1G>T, 50346_+3A>G, 54422-5T>A, 54704-1G>A, 55003+1G>A, 62425+5G>A, 63405A>G, 64489+1G>A, 81898+2T>A, 92569+1G>C relative to the wild-type TTN sequence of TTN (i.e. SEQ ID NO: 1, UniProt Q8WZ42.nt). Mutations are are annotated using Human Genome Variation Society guidelines: available on the world wide web at www.hgvs.org/mutnomen.

In some embodiments, a subject at risk for having or developing DCM can have one of the DCM-risk associated TTN mutations. In some embodiments, a subject at risk for having or developing DCM can have two or more of the DCM-risk associated TTN mutations, e.g. two of the DCM-risk associated TTN mutations. In some embodiments, a subject at risk for having or developing DCM can have one or more of the DCM-risk associated TTN mutations and one or more other mutations known to be associated with a risk for DCM. Other mutations known to be associated with a risk for DCM can be mutations relative to the wild-type sequence of DCM or mutations in other DCM-risk associated genes.

In some embodiments, the methods and compositions described herein relate to determining if any of the TTN mutations described herein (e.g. DCM-risk associated TTN mutations) is present in a nucleic acid sample obtained from a subject. Methods of determining the presence of a mutation in a nucleic acid are known to one of ordinary skill in the art. Examples include, but are not limited to, contacting the sample with a probe capable of detecting at least one of the TTN mutations, sequencing the nucleic acid present in the sample. In some embodiments, the nucleic acid can be transformed into one or more detectable targets before determining the presence of a DCM-risk associated TTN mutation in the nucleic acid sample.

As used herein, the term "probe" means any molecule or reagent that can aid in the detection of a mutation in a nucleic acid. As such, a probe is not limited to an oligonucleotide that hybridizes with the nucleic acid of interest. As used herein, the term probe also includes reagents used in new generation nucleic acid seguing technologies. Further, when the probe is a nucleic acid, e.g., an oligonucleotide, it is not necessary that the probe hybridize to a location that includes the mutation site. Thus, when the probe is a nucleic acid, it can hybridize upstream (5') or downsteam (3') of the mutation site or a region that incudes the mutation site.

In some embodiments, the probe comprises, at its 3'-terminus, a nucleic acid sequence selected from the group consisting of SEQ ID NO: 4-332 and 342-670.

In some embodiments, the probe is a sequencing primer. As used herein, the term "sequencing primer" refers to an oligonucleotide primer that is used to initiate a sequencing reaction performed on a nucleic acid. The term "sequencing primer" refers to both a forward sequencing primer and to a reverse sequencing primer.

Those skilled in the art will readily recognize that nucleic acid molecules can be double-stranded molecules and that reference to a particular site on one strand refers, as well, to the corresponding site on a complementary strand. In defining a mutation, mutation position, or nucleotide sequence, reference to an adenine, a thymine (uridine), a cytosine, or a guanine at a particular site on one strand of a nucleic acid molecule also defines the thymine (uridine), adenine, guanine, or cytosine (respectively) at the corresponding site on a complementary strand of the nucleic acid molecule. Thus, reference can be made to either strand in order to refer to a particular position, mutation, or nucleotide sequence. Probes and primers can be designed to hybridize to either strand and genotyping methods disclosed herein can generally target either strand. Accordingly, the claims are intended to cover analysis of the opposite strand as well. One of skill in the art can readily determine the reverse complement nucleic acid sequence of the TTN mutations and wild-type sequences described herein.

Identification method of mutations can be of either a positive-type (inclusion of an allele) or a negative-type (exclusion of an allele). Positive-type methods determine the identity of a nucleotide contained in a polymorphic site, whereas negative-type methods determine the identity of a nucleotide not present in a polymorphic site. Thus, a wild-type site can be identified either as wild-type or not mutant. For example, at a biallelic polymorphic site where the wild-type allele contains a cytosine and the mutant allele contains adenine, a site can be positively determined to be either adenine or cytosine or negatively determined to be not adenine (and thus cytosine) or not cytosine (and thus adenine).

One aspect of the invention provides a method for determining an increased risk for developing DCM in a subject, by identifying in a biological sample of the subject the TTN muations described herein. The method comprises (a) contacting a nucleic acid sample obtained from the subject with a probe, wherein the probe is capable of detecting one or more of the DCM-risk associated TTN nucleic acid mutations described above herein; and (b) detecting presence or absence of at least one mutation in the TTN nucleic acid wherein the mutations in the TTN nucleic acid is determined based upon the wild type TTN gene sequence of SEQ ID NO: 1. Detection of the presence of at least one DCM-risk associated TTN mutation is indicative of the subject having an increased risk for having or developing DCM.

In one embodiment, contacting the nucleic acid in the sample involves an allelic discrimination method. In one embodiment, the allelic discrimination method involves use of a first oligonucleotide probe, which anneals with a target portion of the individual's genome. As an illustrative example only, the target portion comprises, for example, the 12745C>T mutation described herein. Because the nucleotide residue at this position differs, for example at the position in the C-allele and the T-allele, the first probe is completely complementary to only one of the two alleles. In some embodiments, a second oligonucleotide probe can also be used which is completely complementary to the target portion of the other of the two alleles. The allelic discrimination method can also involves use of at least one, and preferably a pair of amplification primers for amplifying a reference region, for example, at least a portion of the flanking region including the 12745C>T mutation locus.

The probe in some embodiments is a DNA oligonucleotide having a length in the range from about 20 to about 40 nucleotide residues, preferably from about 20 to about 30 nucleotide residues, and more preferably having a length of about 25 nucleotide residues. In one embodiment, the probe is rendered incapable of extension by a PCR-catalyzing enzyme such as Taq polymerase, for example by having a fluorescent probe attached at one or both ends thereof. Although non-labeled oligonucleotide probes can be used in the kits and methods of the invention, the probes are preferably detectably labeled. Exemplary labels include radionuclides, light-absorbing chemical moieties (e.g. dyes), fluorescent moieties, and the like. Preferably, the label is a fluorescent moiety, such as 6-carboxyfluorescein (FAM), 6-carboxy-4,7,2',7'-tetrachlorofluoroscein (TET), rhodamine, JOE (2,7-dimethoxy-4,5-dichloro-6-carboxyfluorescein), HEX (hexachloro-6-carboxyfluorescein), or VIC.

In some embodiments, the probe can comprise both a fluorescent label and a fluorescence-quenching moiety such as 6-carboxy-N,N,N',N'-tetramethylrhodamine (TAMRA), or 4-(4'-dimethlyaminophenylazo)benzoic acid (DABCYL). When the fluorescent label and the fluorescence-quenching moiety are attached to the same oligonucleotide and separated by no more than about 40 nucleotide residues, and preferably by no more than about 30 nucleotide residues, the fluorescent intensity of the fluorescent label is diminished. When one or both of the fluorescent label and the fluorescence-quenching moiety are separated from the oligonucleotide, the intensity of the fluorescent label is no longer diminished. In some embodiments, the probe of the present invention has a fluorescent label attached at or near (i.e. within about 10 nucleotide residues of) one end of the probe and a fluorescence-quenching moiety attached at or near the other end. Degradation of the probe by a PCR-catalyzing enzyme releases at least one of the fluorescent label and the fluorescence-quenching moiety from the probe, thereby discontinuing fluorescence quenching and increasing the detectable intensity of the fluorescent labels. Thus, cleavage of the probe (which, as discussed above, is correlated with complete complementarity of the probe with the target portion) can be detected as an increase in fluorescence of the assay mixture.

If different detectable labels are used, more than one labeled probe can be used, and therefore polymorphisms can be performed in multiplex. For example, the assay mixture can contain a first probe which is completely complementary to the target portion of, for example, the 12745C>T mutation and to which a first label is attached, and a second probe which is completely complementary to the target portion of the 51883C>T DCM risk associated TTN mutation. When two probes are used, the probes are detectably different from each other, having, for example, detectably different size, absorbance, excitation, or emission spectra, radiative emission properties, or the like. For example, a first probe can be completely complementary to the target portion of the polymorphism and have FAM and TAMRA attached at or near opposite ends thereof. The first probe can be used in the method of the present invention together with a second probe which is completely complementary to the target portion of another DCM risk associated TTN mutation and has TET and TAMRA attached at or near opposite ends thereof. Fluorescent enhancement of FAM (i.e. effected by cessation of fluorescence quenching upon degradation of the first probe by Taq polymerase) can be detected at one wavelength (e.g. 518 nanometers), and fluorescent enhancement of TET (i.e. effected by cessation of fluorescence quenching upon degradation of the second probe by Taq polymerase) can be detected at a different wavelength (e.g. 582 nanometers). Using multiplexing methods, more than one mutation described herein can be detected, providing a better diagnosis and more reliable prediction of DCM risk in a subject.

Another allelic discrimination method suitable for use in detection of TTN mutations employs "molecular beacons". Detailed description of this methodology can be found in Kostrikis et al., Science 1998; 279:1228-1229, which is incorporated herein by reference.

The use of microarrays comprising a multiplicity of sequences, e.g., mutations described herein is becoming increasingly common in the art. Accordingly, a microarray having at least one oligonucleotide probe, as described above, appended thereon, can be used for detecting the presence or absence of a DCM-risk associated TTN mutation.

The polymorphisms of the present invention can be detected directly or indirectly using any of a variety of suitable methods including fluorescent polarization, mass spectroscopy, and the like. Suitable methods comprise direct or indirect sequencing methods, restriction site analysis, hybridization methods, nucleic acid amplification methods, gel migration methods, the use of antibodies that are specific for the proteins encoded by the different alleles of the polymorphism, or by other suitable means. Alternatively, many such methods are well known in the art and are described, for example in T. Maniatis et al., Molecular Cloning, a Laboratory Manual, 2nd Edition, Cold Spring Harbor Press, Cold Spring Harbor, N.Y. (1989), J. W. Zyskind et al., Recombinant DNA Laboratory Manual, Academic Press, Inc., New York (1988), and in R. Elles, Molecular Diagnosis of Genetic Diseases, Humana Press, Totowa, N.J. (1996), and Mamotte et al, 2006, Clin Biochem Rev, 27; 63-75) each herein incorporated by reference.

According to the present invention, any approach that detects mutations in a gene can be used, including but not limited to single-strand conformational polymorphism (SSCP) analysis (Orita et al. (1989) Proc. Natl. Acad. Sci. USA 86:2766-2770), heteroduplex analysis (Prior et al. (1995) Hum. Mutat. 5:263-268), oligonucleotide ligation (Nickerson et al. (1990) Proc. Natl. Acad. Sci. USA 87:8923-8927) and hybridization assays (Conner et al. (1983) Proc. Natl. Acad. Sci. USA 80:278-282) and DNA sequence analysis. Traditional Taq polymerase PCR-based strategies, such as PCR-RFLP, allele-specific amplification (ASA) (Ruano and Kidd (1989) Nucleic Acids Res. 17:8392), single-molecule dilution (SMD) (Ruano et al. (1990) Proc. Natl. Acad. Sci. USA 87:6296-6300), and coupled amplification and sequencing (CAS) (Ruano and Kidd (1991) Nucleic Acids Res. 19:6877-6882), are easily performed and highly sensitive methods to determine haplotypes of the present invention (Michalatos-Beloin et al. (1996) Nucleic Acids Res. 24:4841-4843; Barnes (1994) Proc. Natl. Acad. Sci. USA 91:5695-5699; Ruano and Kidd (1991) Nucleic Acids Res. 19:6877-6882).

In some embodiments, the nucleic acid sequences of the gene's allelic variants, or portions thereof, can be the basis for probes or primers, e.g., in methods for determining the identity of the allelic variant of the polymorphic region. Thus, in one embodiment, nucleic acid probes or primers can be used in the methods of the present invention to determine whether a subject is at risk of developing disease such as DCM. One of skill in the art can readily access the nucleic acid sequences flanking or spanning the TTN mutations SNPs described herein by examining SEQ ID NO:1. Thus, a skilled artisan can readily design and optimize primers or probes based on the flanking sequences of the TTN mutations described herein.

One aspect of the invention provides a method for determining an increased risk for developing DCM in a subject, by identifying in a biological sample of the subject the TTN muations described herein. In some embodiments, the method comprises detecting presence or absence of at least one mutation in the TTN nucleic acid wherein the mutations in the TTN nucleic acid is determined based upon the wild type TTN gene sequence of SEQ ID NO:1, and wherein the mutation is selected from the DCM-risk associated TTN mutations described above herein. Detection of the presence of at least one DCM-risk associated TTN mutation is indicative of the subject having an increased risk for having or developing DCM.

In some embodiments, the method comprises: (a) transforming a portion of TTN nucleic acid in sample obtained from the subject into at least one detectable target; and (b) detecting presence or absence of at least one mutation in the TTN nucleic acid wherein the mutations in the TTN nucleic acid is determined based upon the wild type TTN gene sequence of SEQ ID NO:1, and wherein the mutation is selected from the DCM-risk associated TTN mutations described above herein. Detection of the presence of at least one DCM-risk associated TTN mutation is indicative of the subject having an increased risk for having or developing DCM.

As used herein, the term "transforming" or "transformation" refers to changing an object or a substance, e.g., biological sample, nucleic acid or protein, into a substance, which can be differentiated from the first substance. The transformation can be physical, biological or chemical. Exemplary physical transformation includes, but not limited to, pre-treatment of a biological sample, e.g., from whole blood to blood serum by differential centrifugation. A biological/chemical transformation can involve at least one enzyme and/or a chemical reagent in a reaction. For example, a DNA sample can be digested into fragments by one or more restriction enzyme, or an exogenous molecule can be attached to a fragmented DNA sample with a ligase. In some embodiments, a DNA sample can undergo enzymatic replication, e.g., by polymerase chain reaction (PCR).

In some embodiments, restriction enzymes can be utilized to identify variances or a polymorphic site using "restriction fragment length polymorphism" (RFLP) analysis (Lentes et al., Nucleic Acids Res. 16:2359 (1988); and C. K. McQuitty et al., Hum. Genet. 93:225 (1994)). In RFLP, at least one target polynucleotide is digested with at least one restriction enzyme and the resulting restriction fragments are separated based on mobility in a gel. Typically, smaller fragments migrate faster than larger fragments. Consequently, a target polynucleotide that contains a particular restriction enzyme recognition site will be digested into two or more smaller fragments, which will migrate faster than a larger fragment lacking the restriction enzyme site. Knowledge of the nucleotide sequence of the target polynucleotide, the nature of the polymorphic site, and knowledge of restriction enzyme recognition sequences guide the design of such assays. In another embodiment of the present invention, restriction site analysis of particular nucleotide sequence to identify a nucleotide at a polymorphic site is determined by the presence or absence of a restriction enzyme site. A large number of restriction enzymes are known in the art and, taken together, they are capable of recognizing at least one allele of many polymorphisms.

A number of approaches use DNA ligase, an enzyme that can join two adjacent oligonucleotides hybridized to a DNA template. In Oligonucleotide ligaton assay (OLA) the sequence surrounding the mutation site is first amplified and one strand serves as a template for three ligation probes, two of these are ASO (allele-specific oligonucleotides) and a third common probe. Numerous approaches cane be used for the detection of the ligated products, for example the ASOs with differentially labeled with fluorescent of hapten labels and ligated products detected by fluorogenic of colorimetric enzyme-linked immunosorbent assays (To be et al, Nuclic Acid Res, 1996; 24; 3728-32). For electrophorosis-based systems, use of a morbidity modifier taqgs or variation in probe length coupled with floursecence detection enables the multiplex genotyping of several single nucleotide substitutions in a single tube (Baron et al, 1997; Clinical Chem., 43; 1984-6). When used on arrays, ASOs can be spotted at specific locations or addresses on a chip, PCR amplified DNA can then be added and ligation to labeled oligonucleotides at specific addresses on the array measured (Thong et al, Proc Natl Acad Sci 2003; 100; 11559-64).

Allele-specific amplification is also known as amplification refectory mutation system (ARMS) uses allele specific oligonucleotides (ASO)PCR primers and is an well established and known PCR based method for genotyping (Newton et al, J Med Genet, 1991; 28; 248-51). Typically, one of the two oligonucleotide primers used for the PCR binds to the mutation site, and amplification only takes place if the nucleotide of the mutation is present, with a mismatch being refractory to amplification. The resulting PCR Products can be analyzed by any means known to persons skilled in the art. In a variation of the approach, termed mutagenically separated PCR (MS-PCR) the two ARMS primer of different lengths, one specific for the normal gene and one for the mutation are used, to yield PCR procures of different lengths for the normal and mutant alleles (Rust et al, Nucl Acids Res, 1993; 21; 3623-9). Subsequent gel electrophoresis, for example will show at least one of the two allelic products, with normal, mutant or both (heterozygote) genes. A further variation of this forms the basis of the Masscode System™ (www.bioserve.com) which uses small molecular weight tags covalently attached through a photo-cleavable linker to the ARMS primers, with each ARMS primers labeled with a tag of differing weight (Kokoris et al, 2000, 5; 329-40). A catalogue of numerous tags allows simultaneous amplification/genotyping (multiplexing) of 24 different targets in a single PCR reaction. For any one mutation, genotyping is based on comparison of the relative abundance of the two relevant mass tags by mass spectrometry.

Normal or mutant alleles can be genotyped by measuring the binding of allele-specific oligonucleotides (ASO) hybridization probes. In such embodiments, two ASO probes, one complementary to the normal allele and the other to the mutant allele are hybridized to PCR-amplified DNA spanning the mutation site. In some embodiments, the amplified products can be immobilized on a solid surface and hybridization to radiolabelled oligonucleotides such as known as a 'dot-blot' assay. In alternative embodiments, the binding of the PCR products containing a quantifiable label (e.g. biotin or fluorescent labels) to a solid phase allele-specific oligonucleotide can be measured. Alternatively, for a reverse hybridixation assay, or "reverse dot-blot" the binding of PCR products containing a quantifiable label (for example but not limited to biotin or fluorescent labels) to a solid phase allele-specific oligonucleotide can be measured. In some embodiments, the use of microarrays comprising hundreds of ASO immobilized onto a solid support surfaces to form an array of ASO can also be used for large scale genotyping of multiple single polymorphisms simultaneously, for example Affymetrix GENECHIP® Mapping 10K Array, which can easily be performed by persons skilled in the art.

Homogenous assays, also called "closed tube" arrays, genomic DNA and all the reagents required for the amplification and genotyping are added simultaneously. Genotyping can be achieved without any post-amplification processing. In some embodiments, one such homogenous assay is the 5' fluorogenic nuclease assay, also known as the TAQMAN® Assay (Livak et al, Genet Anal, 1999; 14:143-9) and in alternative embodiments Melting curve analyses of FRET probes are used. Such methods are carried out using "real-time" theromcyclers, and utilize two dual-labeled ASO hybridization probes complementary to normal and mutant alleles, where the two probes have different reported labels but a common quencher dye. In such embodiments, the changes in fluorescence characteristics of the probes upon binding to PCR products of target genes during amplification enables "real-time" monitoring of PCR amplification and differences in affinity of the fluorogenic probes for the PCR products of normal and mutant genes enables differentiation of genotypes. The approach uses two dual-labeled ASO hybridization probes complementary to the mutant and normal alleles. The two probes have different fluorescent reported dyes but a common quencher dye. When intact, the probes do not fluoresces due to the proximity of the reporter and quencher dyes. During annealing phase of PCR, two probes compete for hybridization to their target sequences, downstream of the primer sites and are subsequently cleaved by 5' nuclease activity of Thermophilis aquaticus (Taq) polymerase as the primer is extended, resulting in the separation of the reporter dyes from the quencher. Genotyping is determined by measurement of the fluorescent intensity of the two reporter dyes after PCR amplification. Thus, when intact the probes do not fluoresce due to the proximity of the quencher dyes, whereas during the annealing phase of the PCR the probes compete for hybridization of the target sequences and the separation of one of the probes from the quencher which can be detected.

Melting-curve analysis of FRET hybridization is another approach useful in the method of the invention. Briefly, the reaction includes two oligonucleotide probes which when in close proximity forms a fluorescent complex, where one probe often termed the "mutant sensor" probe is designed to specifically hybridize across the mutation site and the other probe (often referred to as the "anchor probe") hybridizes to an adjacent site. Fluorescent light is emitted by the "donor" excites the "acceptor" fluorphore creasing a unique fluorogenic complex, which only forms when the probes bind to adjacent sites on the amplified DNA. The "sensor" probe is complementary to either the normal or the mutant allele. Once PCR is complete, heating of the sample through the melting temperatures of the probe yields a fluorescent temperature curve which differs for the mutant and normal allele.

A variation of the FRET hybridization method is the LCGREEN™ method, which obviates the requirement for fluorescent labeled probes altogether. LCGREEN™ is a sensitive highly fluorogenic double-stranded DNA (dsDNA) binding dye that is used to detect the dissociation of unlabelled probes (Liew et al, Clin Chem, 2004; 50; 1156-64 and Zhou et al, Clin Chem, 2005; 51; 1761-2). The method uses unlabeled allele-specific oligonucleotides probes that are perfectly complementary either to the mutant or normal allele, and the mismatch of the ASO/template double strand DNA complex results in a lower melting temperature and an earlier reduction in fluorescent signal form the dsDNA binding dye with increasing temperature.

The OLA can also be used for FRET Probes (Chen et al, 1998; 8:549-56), for example, the PCR/ligation mixture can contain PCR primers, DNA polymerase without 5' nuclease activity, thermal stable DNA ligase and oligonucleotides for the ligation reaction. The ligation of the allele-specific oligonucleotides have a different acceptor fluorophore and the third ligation oligonucleotide, which binds adjacently to the ASO has a donor fluorophore, and the three ligation oligonucleotides are designed to have a lower melting temperature for the PCR primers to prevent their interference in the PCR amplification. Following PCR, the temperature is lowered to allow ligation to proceed, which results in FRET between the donor and acceptor dyes, and alleles can be disconcerted by comparing the fluorescence emission of the two dyes.

The OLA can also be performed by the use of FRET probes (Chen et al, Genome Res, 1998; 8: 549-56). In such an embodiment, the PCR/ligation mix contains PCR primers, a thermostable DNA polymerase without 5' exonuclease activity (to prevent the cleavage of ligation probes during the ligation phase), a thermostable DNA ligase as well as the oligonucleotides for the ligation reaction. The ligation of the ASO each have a different acceptor fluorophore and the third ligation oligonucleotide which binds adjacently to the ASO has a donor fluorophore. The three ligation oligonucleotides are designed to habe a lower melting temperature than the annealing temperature for the PCR primers prevent their interference in PCR amplification. Following PCR, the temperature is lowered to allow ligation to proceed. Ligation results in FRET between donor and acceptor dyes, and alleles can be discerned by comparing the fluorescence emission of the two dyes.

Further, variations of the homogenous PCR- and hybridization based techniques to detect polymorphisms are also encompassed in the present invention. For example, the use of Molecular Beacons (Tyagi et al, Nat Biotech 1998; 16; 49-53) and SCORPION® Probes (Thelwell et al, Nucleic Acid Res 2000; 28; 3752-61). Molecular Beacons are comprised of oligonucleotides that have fluorescent reporter and dyes at their 5' and 3' ends, with the central portion of the oligonucleotide hybridizing across the target sequence, but the 5' and 3' flanking regions are complementary to each other. When not hybridized to their target sequence, the 5' and 3' flanking regions hybridize to form a stem-loop structure, and there is little fluorescence because of the proximity of the reported and the quencher dyes. However, upon hybridization to their target sequence, the dyes are separated and there is a large increase in the fluorescence. Mismatched probe-target hybrids dissociate at substantially lower temperatures than exactly matched complementary hybrids. There are a number of variations of the "molecular Beacon" approach. In some embodiments, such a variation includes use of SCORPION® Probes which are similar but incorporate a PCR primer sequence as part of the probe (Thelwell et al, Nucleic Acid Res 2000; 28; 3752-61). In another variation, 'duplex' format gives a better fluorescent signal (Solinas et al, Nucleic Acid Res, 2001, 29; E96).

In another embodiment, polymorphisms can be detected by genotyping using a homogenous or real-time analysis on whole blood samples, without the need for DNA extraction or real-time PCR. Such a method is compatible with FRET and TAQMAN® (Castley et al, Clin Chem, 2005; 51; 2025-30) enabling extremely rapid screening for the particular polymorphism of interest.

In FP, the degree to which the emitted light remains polarized in a particular plane is proportional to the speed at which the molecules rotate and tumble in solution. Under constand pressure, temperature and viscosity, FP is directly related to the molecular weight of a fluorescent species. Therefore, when a small fluorescent molecule is incorporated into a larger molecule, there is an increase in FR FP can be used in for genotyping of polymorphisms of interest (Chen et al, Genome Res, 1999; 9: 492-8 and Latif et al, Genome Res, 2001; 11; 436-40). FP can be utilized in 5' nuclease assay (as described above), where the oligonucleotide probe is digested to a lower molecule weight species, for example is amenable to analysis by FP, but with the added benefit of not requiring a quencher. For example, Perlkin-Elmers AcycloPrime™-FP SNP Detection Kit can be used as a FP minisequencing method. Following PCR amplification, unincorporated primers and nucleotides are degraded enzymatially, the enzymes heat inactivated and a miniseqencing reaction using DNA polymerase and fluorescent-labelled dideoxynucleotides performed. FP is then measured, typically in a 96- to 386-well plate format on a FP-plate reader.

One aspect of the invention provides a method for determining an increased risk for developing DCM in a subject, by identifying in a biological sample of the subject the TTN muations described herein. The method comprises (a) sequencing at least a portion of a TTN nucleic acid in a sample obtained from the subject; (b) comparing the sequence obtained in step (a) with the wildtype TTN sequence of SEQ ID NO: 1 to determine the presence or absence of a TTN mutation; and wherein the mutation is selected from the DCM-risk associated TTN mutations described above herein. Detection of the presence of at least one DCM-risk associated TTN mutation is indicative of the subject having an increased risk for having or developing DCM.

Single base-extension or minisequencing involves annealing an oligonucleotide primer to the single strand of a PCR product and the addition of a single dideoxynucleotide by thermal DNA polymerase. The oligonucleotide is designed to be one base short of the mutation site. The dideoxynucleotide incorporated is complementary to the base at the mutation site. Approaches cans uses different fluorescent tags or haptens for each of the four different dideoxynucleotides (Pastinen et al, Clin Chem 1996, 42; 1391-7). The dideoxynucleotide differ in molecular weight and this is the basis for single-base extension methods utilizing mass-spectrometry, and genotyping based on the mass of the extended oligonucleotide primer, can be used, for example matrix-assisted laser adsorption/ionization time-of flight mass spectrometry or MALDI-TOF (Li et al, Electrophoresis, 1999, 20; 1258-65), which is quantitative and can be used to calculate the relative allele abundance making the approach suitable for other applications such as gene dosage studies (for example for estimation of allele frequencies on pooled DNA samples).

Minisequencing or Microsequencing by MALDI-TOF can be performed by means known by persons skilled in the art. In a variation of the MALDI-TOF technique, some embodiments can use the Sequenom's Mass Array Technology (www.sequenom.com) (Sauser et al, Nucleic Acid Res, 2000, 28; E13 and Sauser et al, Nucleic Acid Res 2000, 28: E100). and also the GOOD Assay (Sauer S et al, Nucleic Acid Res, 2000; 28, E13 and Sauer et al, Nucleic Acid Res, 2000; 28:E100).

In some embodiments, variations of MALDI-TOF can be performed for analysis of variances in the genes associated with mutations described herein. For example, MALDI and electrospray ioinization (ESI) (Sauer S. Clin Chem Acta, 2006; 363; 93-105) is also useful with the methods of the present invention.

In some embodiments, the primer extension reaction and analysis is performed using PYROSEQUENCING™ (Uppsala, Sweden) which essentially is sequencing by synthesis. A sequencing primer, designed directly next to the nucleic acid differing between the disease-causing mutation and the normal allele is first hybridized to a single stranded, PCR amplified DNA template from the individual, and incubated with the enzymes, DNA polymerase, ATP sulfurylase, luciferase and apyrase, and the substrates, adenosine 5' phosphosulfate (APS) and luciferin. One of four deoxynucleotide triphosphates (dNTP), for example, corresponding to the nucleotide present in the mutation or polymorphism, is then added to the reaction. DNA polymerase catalyzes the incorporation of the dNTP into the standard DNA strand. Each incorporation event is accompanied by release of pyrophosphate (PPi) in a quantity equimolar to the amount of incorporated nucleotide. Consequently, ATP sulfurylase converts PPi to ATP in the presence of adenosine 5' phosphosulfate. This ATP drives the luciferase-mediated conversion of luciferin to oxyluciferin that generates visible light in amounts that are proportional to the amount of ATP. The light produced in the luciferase-catalyzed reaction is detected by a charge coupled device (CCD) camera and seen as a peak in a PYROGRAM™. Each light signal is proportional to the number of nucleotides incorporated and allows a clear determination of the presence or absence of, for example, the mutation or polymorphism. Thereafter, apyrase, a nucleotide degrading enzyme, continuously degrades unincorporated dNTPs and excess ATP. When degradation is complete, another dNTP is added which corresponds to the dNTP present in for example the selected SNP. Addition of dNTPs is performed one at a time. Deoxyadenosine alfa-thio triphosphate (dATPS) is used as a substitute for the natural deoxyadenosine triphosphate (dATP) since it is efficiently used by the DNA polymerase, but not recognized by the luciferase. For detailed information about reaction conditions for the PYROSEQUENCING, see, e.g. U.S. Pat. No. 6,210,891, which is incorporated herein by reference in its entirety.

Other techniques known to persons skilled in the art are also incorporated for use with the present invention, for example see Kwok, Hum Mut 2002; 9; 315-323 and Kwok, Annu Rev Genomic Hum Genetics, 2001; 2; 235-58 for reviews, which are incorporated herein in their entirety by reference. Examples of other techniques to detect variances and/or polymorphisms are the INVADER® Assay (Gut et al, Hum Mutat, 2001; 17:475-92, Shi et al, Clin Chem, 2001, 47, 164-92, and Olivier et al, Mutat Res, 2005; 573:103-110), the method utilizing FLAP endonucleases (U.S. Pat. No. 6,706,476) and the SNPlex genoptyping systems (Tobler et al, J. Biomol Tech, 2005; 16; 398-406.

In one embodiment, a long-range PCR (LR-PCR) is used to detect mutations or polymorphisms of the present invention. LR-PCR products are genotyped for mutations or polymorphisms using any genotyping methods known to one skilled in the art, and haplotypes inferred using mathematical approaches (e.g., Clark's algorithm (Clark (1990) Mol. Biol. Evol. 7:111-122).

For example, methods including complementary DNA (cDNA) arrays (Shalon et al., Genome Research 6(7):639-45, 1996; Bernard et al., Nucleic Acids Research 24(8): 1435-42, 1996), solid-phase mini-sequencing technique (U.S. Pat. No. 6,013,431, Suomalainen et al. Mol. Biotechnol. June; 15(2):123-31, 2000), ion-pair high-performance liquid chromatography (Doris et al. J. Chromatogr. A can 8; 806(1):47-60, 1998), and 5' nuclease assay or real-time RT-PCR (Holland et al. Proc Natl Acad Sci USA 88: 7276-7280, 1991), or primer extension methods described in the U.S. Pat. No. 6,355,433, can be used.

Molecular beacons also contain fluorescent and quenching dyes, but FRET only occurs when the quenching dye is directly adjacent to the fluorescent dye. Molecular beacons are designed to adopt a hairpin structure while free in solution, bringing the fluorescent dye and quencher in close proximity. Therefore, for example, two different molecular beacons are designed, one recognizing the mutation or polymorphism and the other the corresponding wildtype allele. When the molecular beacons hybridize to the nucleic acids, the fluorescent dye and quencher are separated, FRET does not occur, and the fluorescent dye emits light upon irradiation. Unlike TaqMan probes, molecular beacons are designed to remain intact during the amplification reaction, and must rebind to target in every cycle for signal measurement. TaqMan probes and molecular beacons allow multiple DNA species to be measured in the same sample (multiplex PCR), since fluorescent dyes with different emission spectra can be attached to the different probes, e.g. different dyes are used in making the probes for different DCM-risk associated mutations. Multiplex PCR also allows internal controls to be co-amplified and permits allele discrimination in single-tube assays. (Ambion Inc, Austin, Tex., TechNotes 8(1)-February 2001, Real-time PCR goes prime time).

Another method to detect mutations or polymorphisms is by using fluorescence tagged dNTP/ddNTPs. In addition to use of the fluorescent label in the solid phase mini-sequencing method, a standard nucleic acid sequencing gel can be used to detect the fluorescent label incorporated into the PCR amplification product. A sequencing primer is designed to anneal next to the base differentiating the mutations and wildtype alleles. A primer extension reaction is performed using chain terminating dideoxyribonucleoside triphosphates (ddNTPs) labeled with a fluorescent dye, one label attached to the ddNTP to be added to the standard nucleic acid and another to the ddNTP to be added to the target nucleic acid.

Alternatively, an INVADER® assay can be used (Third Wave Technologies, Inc (Madison, Wis.)). This assay is generally based upon a structure-specific nuclease activity of a variety of enzymes, which are used to cleave a target-dependent cleavage structure, thereby indicating the presence of specific nucleic acid sequences or specific variations thereof in a sample (see, e.g. U.S. Pat. No. 6,458,535). For example, an INVADER® operating system (OS), provides a method for detecting and quantifying DNA and RNA. The INVADER® OS is based on a "perfect match" enzyme-substrate reaction. The INVADER® OS uses proprietary CLEAVASE® enzymes (Third Wave Technologies, Inc (Madison, Wis.)), which recognize and cut only the specific structure formed during the INVADER® process which structure differs between the different alleles selected for detection, i.e. the wildtype TTN sequence and the DCM-risk associated mutations. Unlike the PCR-based methods, the INVADER® OS relies on linear amplification of the signal generated by the INVADER® process, rather than on exponential amplification of the target.

In the INVADER® process, two short DNA probes hybridize to the target to form a structure recognized by the CLEAVASE® enzyme. The enzyme then cuts one of the probes to release a short DNA "flap." Each released flap binds to a fluorescently-labeled probe and forms another cleavage structure. When the CLEAVASE® enzyme cuts the labeled probe, the probe emits a detectable fluorescence signal.

Mutations or polymorphisms can also be detected using allele-specific hybridization followed by a MALDI-TOF-MS detection of the different hybridization products. In the preferred embodiment, the detection of the enhanced or amplified nucleic acids representing the different alleles is performed using matrix-assisted laser desorption ionization/time-of-flight (MALDI-TOF) mass spectrometric (MS) analysis described in the Examples below. This method differentiates the alleles based on their different mass and can be applied to analyze the products from the various above-described primer-extension methods or the INVADER® process.

In one embodiment, a haplotyping method can be used for the purpose of the invention. A halotyping method is a physical separation of alleles by cloning, followed by sequencing. Other methods of haplotyping include, but are not limited to monoallelic mutation analysis (MAMA) (Papadopoulos et al. (1995) Nature Genet. 11:99-102) and carbon nanotube probes (Woolley et al. (2000) Nature Biotech. 18:760-763). U.S. Patent Application No. US 2002/0081598 also discloses a useful haplotying method which involves the use of PCR amplification.

Computational algorithms such as expectation-maximization (EM), subtraction and PHASE are useful methods for statistical estimation of haplotypes (see, e.g., Clark, A. G. Inference of haplotypes from PCR-amplified samples of diploid populations. Mol Biol Evol 7, 111-22. (1990); Stephens, M., Smith, N.J. & Donnelly, P. A new statistical method for haplotype reconstruction from population data. Am J Hum Genet. 68, 978-89. (2001); Templeton, A. R., Sing, C. F., Kessling, A. & Humphries, S. A cladistic analysis of phenotype associations with haplotypes inferred from restriction endonuclease mapping. II. The analysis of natural populations. Genetics 120, 1145-54. (1988)).

Other methods for genetic screening can be used within the scope of the present invention, for example, to detect mutations in genomic DNA, cDNA and/or RNA samples. Methods commonly used, or newly developed or methods yet unknown are encompassed for used in the present invention. Examples of newly discovered methods include for example, but are not limited to; SNP mapping (Davis et al, Methods Mol Biology, 2006; 351; 75-92); Nanogen Nano Chip, (keen-Kim et al, 2006; Expert Rev Mol Diagnostic, 6; 287-294); Rolling circle amplification (RCA) combined with circularable oligonucleotide probes (c-probes) for the detection of nucleic acids (Zhang et al, 2006: 363; 61-70), luminex XMAP system for detecting multiple SNPs in a single reaction vessel (Dunbar S A, Clin Chim Acta, 2006; 363; 71-82; Dunbar et al, Methods Mol Med, 2005; 114: 147-1471) and enzymatic mutation detection methods (Yeung et al, Biotechniques, 2005; 38; 749-758).

Methods used to detect point mutations include denaturing gradient gel electrophoresis ("DGGE"), restriction fragment length polymorphism analysis ("RFLP"), chemical or enzymatic cleavage methods, direct sequencing of target regions amplified by PCR (see above), single strand conformation polymorphism analysis ("SSCP") and other methods well known in the art.

One method of screening for point mutations is based on RNase cleavage of base pair mismatches in RNA/DNA or RNA/RNA heteroduplexes. As used herein, the term "mismatch" is defined as a region of one or more unpaired or mispaired nucleotides in a double-stranded RNA/RNA, RNA/DNA or DNA/DNA molecule. This definition thus includes mismatches due to insertion/deletion mutations, as well as single or multiple base point mutations.

In such embodiments, protection from cleavage agents (such as a nuclease, hydroxylamine or osmium tetroxide and with piperidine) can be used to detect mismatched bases in RNA/RNA DNA/DNA, or RNA/DNA heteroduplexes (see, e.g., Myers et al. (1985) Science 230:1242). In general, the technique of "mismatch cleavage" starts by providing heteroduplexes formed by hybridizing a control nucleic acid, which is optionally labeled, e.g., RNA or DNA, comprising a nucleotide sequence of the allelic variant of the gene of interest with a sample nucleic acid, e.g., RNA or DNA, obtained from a tissue sample. The double-stranded duplexes are treated with an agent which cleaves single-stranded regions of the duplex such as duplexes formed based on basepair mismatches between the control and sample strands. For instance, RNA/DNA duplexes can be treated with RNase and DNA/DNA hybrids treated with S1 nuclease to enzymatically digest the mismatched regions. In other embodiments, either DNA/DNA or RNA/DNA duplexes can be treated with hydroxylamine or osmium tetroxide and with piperidine in order to digest mismatched regions. After digestion of the mismatched regions, the resulting material is then separated by size on denaturing polyacrylamide gels to determine whether the control and sample nucleic acids have an identical nucleotide sequence or in which nucleotides they are different. See, for example, U.S. Pat. No. 6,455,249, Cotton et al. (1988) Proc. Natl. Acad. Sci. USA 85:4397; Saleeba et al. (1992) Methods Enzy. 217:286-295. In another embodiment, the control or sample nucleic acid is labeled for detection.

U.S. Pat. No. 4,946,773 describes an RNaseA mismatch cleavage assay that involves annealing single-stranded DNA or RNA test samples to an RNA probe, and subsequent treatment of the nucleic acid duplexes with RNaseA. For the detection of mismatches, the single-stranded products of the RNaseA treatment, electrophoretically separated according to size, are compared to similarly treated control duplexes. Samples containing smaller fragments (cleavage products) not seen in the control duplex are scored as positive.

Other investigators have described the use of RNaseI in mismatch assays. The use of RNaseI for mismatch detection is described in literature from Promega Biotech. Promega markets a kit containing RNaseI that is reported to cleave three out of four known mismatches.

In other embodiments, alterations in electrophoretic mobility is used to identify the particular allelic variant. For example, single strand conformation polymorphism (SSCP) can be used to detect differences in electrophoretic mobility between mutant and wild type nucleic acids (Orita et al. (1989) Proc Natl. Acad. Sol USA 86:2766; Cotton (1993) Mutat. Res. 285:125-144 and Hayashi (1992) Genet Anal Tech Appl 9:73-79). Single-stranded DNA fragments of sample and control nucleic acids are denatured and allowed to renature. The secondary structure of single-stranded nucleic acids varies according to sequence, the resulting alteration in electrophoretic mobility enables the detection of even a single base change. The DNA fragments can be labeled or detected with labeled probes. The sensitivity of the assay can be enhanced by using RNA (rather than DNA), in which the secondary structure is more sensitive to a change in sequence. In another preferred embodiment, the subject method utilizes heteroduplex analysis to separate double stranded heteroduplex molecules on the basis of changes in electrophoretic mobility (Keen et al. (1991) Trends Genet. 7:5).

Gel Migration Single strand conformational polymorphism (SSCP; M. Orita et al., Genomics 5:8 74-8 79 (1989); Huinphfies et al., In: Molecular Diagnosis of Genetic Diseases, R. Elles, ed. pp 321-340 (1996)) and temperature gradient gel electrophoresis (TGGE; R. M. Wartell et al., Nucl. Acids Res. 18:2699-2706 (1990)) are examples of suitable gel migration-based methods for determining the identity of a polymorphic site. In SSCP, a single strand of DNA will adopt a conformation that is uniquely dependent of its sequence composition. This conformation is usually different, if even a single base is changed. Thus, certain embodiments of the present invention, SSCP can be utilized to identify polymorphic sites, as wherein amplified products (or restriction fragments thereof of the target polynucleotide are denatured, then run on a non-denaturing gel. Alterations in the mobility of the resultant products are thus indicative of a base change. Suitable controls and knowledge of the "normal" migration patterns of the wild-type alleles can be used to identify polymorphic variants.

In yet another embodiment, the identity of the allelic variant is obtained by analyzing the movement of a nucleic acid comprising the polymorphic region in polyacrylamide gels containing a gradient of denaturant, which is assayed using denaturing gradient gel electrophoresis (DGGE) (Myers et al. (1985) Nature 313:495). When DGGE is used as the method of analysis, DNA will be modified to insure that it does not completely denature, for, example by adding a GC clamp of approximately 40 bp of high-melting GC rich DNA by PCR. In a further embodiment, a temperature gradient is used in place of a denaturing agent gradient to identify differences in the mobility of control and sample DNA (Rosenbaum and Reissner (1987) Biophys Chem 265:1275).

Others have described using the MutS protein or other DNA-repair enzymes for detection of single-base mismatches. Alternative methods for detection of deletion, insertion or substitution mutations that can be used in the practice of the present invention are disclosed in U.S. Pat. Nos. 5,849,483, 5,851,770, 5,866,337, 5,925,525 and 5,928,870, each of which is incorporated herein by reference in its entirety. Several methods have been developed to screen polymorphisms and some examples are listed below. The reference of Kwok and Chen (2003) and Kwok (2001) provide overviews of some of these methods, both of these references are specifically incorporated by reference.

Examples of identifying polymorphisms and applying that information in a way that yields useful information regarding patients can be found, for example, in U.S. Pat. No. 6,472,157; U.S. Patent Application Publications 20020016293, 20030099960, 20040203034; WO 0180896, all of which are hereby incorporated by reference.

In another embodiment, multiplex PCR procedures using allele-specific primers can be used to simultaneously amplify multiple regions of a target nucleic acid (PCT Application WO89/10414), enabling amplification only if a particular allele is present in a sample. Other embodiments using alternative primer-guided nucleotide incorporation procedures for assaying polymorphic sites in DNA can be used, and have been described (Komher, J. S. et al., Nucl. Acids. Res. 17:7779-7784 (1989); Sokolov, B. P., Nucl. Acids Res. 18:3671 (1990); Syvanen, A.-C., et al., Genomics 8:684-692 (1990); Kuppuswamy, M. N. et al., Proc. Nat. Acad. Sci. (U.S.A) 88:1143-1147 (1991); Bajaj et al. (U.S. Pat. No. 5,846,710); Prezant, T. R. et al., Hum Mutat. 1: 159-164 (1992); Ugozzoli, L. et al., GATA 9:107-112 47 (1992); Nyr6n, P. et al., Anal. Biochem. 208:171-175 (1993)).

Other known nucleic acid amplification procedures include transcription-based amplification systems (Malek, L. T. et al., U.S. Pat. No. 5,130,238; Davey, C. et al., European Patent Application 329,822; Schuster et al.) U.S. Pat. No. 5,169,766; Miller, H. I. et al., PCT-Application WO89/06700; Kwoh, D. et al., Proc. Natl. Acad. Sci. (U.S.A) 86:1173 Z1989); Gingeras, T. R. et al., PCT Application WO88/10315)), or isothermal amplification methods (Walker, G. T. et al., Proc. Natl. 4cad Sci. (U.S.A) 89:392-396 (1992)) can also be used.

Another method to determine genetic variation is using "gene chips." Probes can be affixed to surfaces for use as "gene chips." Such gene chips can be used to detect genetic variations by a number of techniques known to one of skill in the art. In one technique, oligonucleotides are arrayed on a gene chip for determining the DNA sequence of a by the sequencing by hybridization approach, such as that outlined in U.S. Pat. Nos. 6,025,136 and 6,018,041. The probes of the present invention also can be used for fluorescent detection of a genetic sequence. Such techniques have been described, for example, in U.S. Pat. Nos. 5,968,740 and 5,858,659. A probe also can be affixed to an electrode surface for the electrochemical detection of nucleic acid sequences such as described by Kayyem et al. U.S. Pat. No. 5,952,172 and by Kelley, S. O. et al. (1999) Nucleic Acids Res. 27:4830-4837.

Any oligonucleotide-based diagnostic may be utilized to determine whether a sample includes the presence or absence of a polymorphic variant in a sample. For example, primer extension methods, ligase sequence determination methods (e.g., U.S. Pat. Nos. 5,679,524 and 5,952,174, and WO 01/27326), mismatch sequence determination methods (e.g., U.S. Pat. Nos. 5,851,770; 5,958,692; 6,110,684; and 6,183,958), microarray sequence determination methods, restriction fragment length polymorphism (RFLP), single strand conformation polymorphism detection (SSCP) (e.g., U.S. Pat. Nos. 5,891,625 and 6,013,499), PCR-based assays (e.g., TAQMAN™ PCR System (Applied Biosystems)), and nucleotide sequencing methods may be used. Oligonucleotide extension methods typically involve providing a pair of oligonucleotide primers in a polymerase chain reaction (PCR) or in other nucleic acid amplification methods for the purpose of amplifying a region from the nucleic acid sample that comprises the polymorphic variation. One oligonucleotide primer is complementary to a region 3' or downstream of the polymorphism and the other is complementary to a region 5' or upstream of the polymorphism. A PCR primer pair may be used in methods disclosed in U.S. Pat. Nos. 4,683,195; 4,683,202, 4,965,188; 5,656,493; 5,998,143; 6,140,054; WO 01/27327; and WO 01/27329 for example. PCR primer pairs may also be used in any commercially available machines that perform PCR, such as any of the GENEAMP™, systems available from Applied Biosystems. Also, those of ordinary skill in the art will be able to design oligonucleotide primers based upon the nucleotide sequences set forth in SEQ ID NO:1.

Determination of the presence or absence of a TTN mutation described herein can also involve the use of an extension oligonucleotide that hybridizes to the amplified fragment adjacent to the polymorphic variation. An adjacent fragment refers to the 3' end of the extension oligonucleotide being often 1 nucleotide from the 5' end of the polymorphic site, and sometimes 2, 3, 4, 5, 6, 7, 8, 9, or 10 nucleotides from the 5' end of the polymorphic site, in the nucleic acid when the extension oligonucleotide is hybridized to the nucleic acid. The extension oligonucleotide then is extended by one or more nucleotides, and the number and/or type of nucleotides that are added to the extension oligonucleotide determine whether the polymorphic variant is present. Oligonucleotide extension methods are disclosed, for example, in U.S. Pat. Nos. 4,656,127; 4,851,331; 5,679,524; 5,834,189; 5,876,934; 5,908,755; 5,912,118; 5,976,802; 5,981,186; 6,004,744; 6,013,431; 6,017,702; 6,046,005; 6,087,095; 6,210,891; and WO 01/20039. Oligonucleotide extension methods using mass spectrometry are described, for example, in U.S. Pat. Nos. 5,547,835; 5,605,798; 5,691,141; 5,849,542; 5,869,242; 5,928,906; 6,043,031; and 6,194,144. Multiple extension oligonucleotides may be utilized in one reaction, which is referred to as multiplexing.

In some embodiments, the methods and assays described herein can comprise administering a treatment for DCM if the subject is determined to be at risk for DCM, e.g. if a sample obtained from the subject is determined to comprise at least one of the DCM-risk associated TTN mutations described herein. Methods of treating DCM are known to one of skill in the art and include, but are not limited to the use of angiotensin-converting enzyme (ACE) inhibitors, angiotensin II receptor blockers, beta blockers, diuretics, aldosterone antagonists, digoxin (Lanoxin), blood thinning medications, biventricular pacemakers, implantable cardioverter-defibrillators (ICDs), heart pumps (left ventricular assist devices, or LVADs), heart transplant, salt restriction, digitalis, alcohol restriction, reverse remodeling, conenzyme Q10, and any combinations thereof. A subject determined to have an increased DCM risk can further be given life-style advice, dietary advice, follow-up scheduling advice or agents that may assist in preventing or slowing down sympstons or development of DCM.

In some embodiments, a subject treated according to the methods described herein is asymptomatic. In some embodiments, a subject treated according to the methods described herein has idiopathic DCM.

In some embodiments, the methods described herein relating to treating DCM in a subject can comprise administering a polypeptide comprising titin (e.g. a polypeptide comprising the sequence of SEQ ID NO:2). In some embodiments, a polypeptide comprising the sequence of SEQ ID NO:2 is administered. In some embodiments, a nucleic acid encoding the sequence of SEQ ID NO: 2 is administered.

Subjects determined to have one or more of the DCM-risk associated TTN mutations described herein can be suffering from a lack of full-length, or fully functional titin. Accordingly, in some embodiments, a subject determined to have one or more of the DCM-risk associated TTN mutations described herein can be administered a polypeptide comprising titin (e.g. a polypeptide having the sequence of SEQ ID NO:2). In some embodiments, a polypeptide comprising the sequence of SEQ ID NO:2 is administered. In some embodiments, a nucleic acid encoding the sequence of SEQ ID NO: 2 is administered.

As used herein, the terms "treatment" and "treating," with respect to treatment of DCM, means preventing the progression of the disease, or altering the course of the disorder (for example, but not limited to, slowing the progression of the disorder), or reversing a symptom of the disorder or reducing one or more symptoms and/or one or more biochemical markers in a subject, preventing one or more symptoms from worsening or progressing, promoting recovery or improving prognosis. For example, in the case of DCM treatment, therapeutic treatment can refer to reducing the myocardial enlargement in a subject. Measurable lessening includes any statistically significant decline in a measurable marker or symptom, such as measuring the size of the subject's heart or the performance of the subject's heart after treatment.

In some embodiments, a nucleic acid encoding a polypeptide comprising the amino acid sequence of SEQ ID NO: 2 is administered to a subject. In some embodiments, the nucleic acid encoding the polypeptide of SEQ ID NO: 2 is operably linked to a vector. In some embodiments, the nucleic acid encoding the polypeptide of SEQ ID NO: 2 is a recombinant gene.

Gene therapy has the advantage of potentially long-term therapeutic benefit with only one, or perhaps a limited number, of administrations. These methods allow clinicians to introduce DNA coding for a gene of interest directly into a patient (in vivo gene therapy) or into cells isolated from a patient or a donor (ex vivo gene therapy). Therapeutic proteins produced by transduced cells after gene therapy may be maintained at a relatively constant level in the myocardial tissue of a subject, as compared to a protein that is administered directly, which will typically vary greatly in concentration between the time right after administration of a first dose and the time immediately before the succeeding dose.

Administration of gene therapy vectors can be performed by intravenous, intramuscular, intraarterial, intraventricular, intracardiac, intradermal, intraperitoneal, subcutaneous, subcuticular, and/or intraarticular administration with known techniques.

Further, regulatable genetic constructs using small molecule inducers have been developed that might be included in vectors to be used in gene therapy embodiments of the present invention. Rivera et al. (1996) Nat. Med. 2:1028-32; No et al. (1996) Proc. Natl. Acad. Sci. USA, 93:3346-51;

Gossen and Bujard (1992) Proc. Natl. Acad. Sci. USA 89:5547-51; the GeneSwitch® system (Valentis, Inc., Burlingame, Calif.). These systems are based on the use of engineered transcription factors whose activity is controlled by a small molecule drug, and a transgene whose expression is driven by the regulated transcription factor. One such system, based on induction by rapamycin (referred to herein as the "dimerizer system"), involves formation of a functional transcription factor from two synthetic fusion proteins dependent upon addition of rapamycin. Rivera et al. (1996) Nat. Med. 2:1028-32; Pollock et al. (2000) Proc. Natl. Acad. Sci. USA 97:13221-26. The dimerizer system is a component of the ARGENT Transcription Technology platform of ARIAD Pharmaceuticals, Inc. (Cambridge, Mass.). See U.S. Pat. Nos. 6,043,082 and 6,649,595; Rivera et al. (1999) Proc. Natl. Acad. Sci. USA 96:8657-62.

DNA may be introduced into a patient's cells in several ways. There are transfection methods, including chemical methods such as calcium phosphate precipitation and liposome-mediated transfection, and physical methods such as electroporation. In general, transfection methods are not suitable for in vivo gene delivery. Genes can be delivered using "naked" DNA in plasmid form. There are also methods that use recombinant viruses. Current viral-mediated gene delivery methods employ retrovirus, adenovirus, herpes virus, pox virus, and adeno-associated virus (AAV) vectors. Of the more than one hundred gene therapy trials conducted, more than 95% used viral-mediated gene delivery. C. P. Hodgson, Bio/Technology 13, 222-225 (1995).

In one embodiment, the recombinant titin encoding gene is operably linked to a vector. In general, as used herein, the term "vector" refers to any genetic element, such as a plasmid, phage, transposon, cosmid, chromosome, virus, virion, etc., that is capable of replication when associated with the proper control elements and that can transfer gene sequences to cells. Thus, the term includes cloning and expression vehicles, as well as viral vectors. By "recombinant vector" is meant a vector that includes a heterologous nucleic acid sequence, or "transgene," that is capable of expression in vivo.

In additional embodiments, it can be desirable to fuse the gene of interest to immunoglobulin molecules, for example the Fc portion of a mouse IgG2a with a noncytolytic mutation, to provide for sustained expression. Such a technique has been shown to provide for sustained expression of cytokines, especially when combined with electroporation. See e.g. Jiang et al. (2003) J. Biochem. 133:423-27; Adachi et al. (2002) Gene Ther. 9:577-83.

It should be understood that the vectors delivered by the methods of the present invention be combined with other suitable compositions and therapies for DCM.

Plasmid-Directed Gene Delivery

The recombinant titin encoding gene can be delivered using non-viral plasmid-based nucleic acid delivery systems, as described in U.S. Pat. Nos. 6,413,942, 6,214,804, 5,580,859, 5,589,466, 5,763,270 and 5,693,622, all incorporated herein by reference in their entireties. Plasmids will include the gene of interest operably linked to control elements that direct the expression of the gene in a target cell, which control elements are well known in the art. Plasmid DNA can be guided by a nuclear localization signal or like modification.

Alternatively, plasmid vectors encoding the gene of interest can be packaged in liposomes prior to delivery to a subject or to cells, as described in U.S. Pat. Nos. 5,580,859, 5,549,127, 5,264,618, 5,703,055, all incorporated herein by reference in their entireties. For a review of the use of liposomes as carriers for delivery of nucleic acids, see, Hug and Sleight (1991) Biochim. Biophys. Acta. 1097:1-17; Straubinger et al. (1983) in Methods of Enzymology Vol. 101, pp. 512-27; de Lima et al. (2003) Current Medicinal Chemistry, Volume 10(14): 1221-31. The DNA can also be delivered in cochleate lipid compositions similar to those described by Papahadjopoulos et al. (1975) Biochem. Biophys. Acta. 394:483-491. See also U.S. Pat. Nos. 4,663,161 and 4,871,488, incorporated herein by reference in their entireties. In one embodiment, the plasmid vector is complexed with Lipofectamine 2000 at a ratio of 3 µL1 of Lipofectamine per µg of DNA. Wang et al. (2005) Mol. Therapy 12(2):314-320.

Biolistic delivery systems employing particulate carriers such as gold and tungsten may also be used to deliver genes of interest. The particles are coated with the gene to be delivered and accelerated to high velocity, generally under reduced pressure, using a gun powder discharge from a "gene gun." See, e.g., U.S. Pat. Nos. 4,945,050, 5,036,006, 5,100,792, 5,179,022, 5,371,015, and 5,478,744, all incorporated herein by reference in their entireties.

A wide variety of other methods can be used to deliver the vectors. Such methods include DEAE dextran-mediated transfection, calcium phosphate precipitation, polylysine- or polyornithine-mediated transfection, or precipitation using other insoluble inorganic salts, such as strontium phosphate, aluminum silicates including bentonite and kaolin, chromic oxide, magnesium silicate, talc, and the like. Other useful methods of transfection include electroporation, sonoporation, protoplast fusion, peptoid delivery, or microinjection. See, e.g., Sambrook et al (1989) Molecular Cloning, A Laboratory Manual, Cold Spring Harbor Laboratories, New York, for a discussion of techniques for transforming cells of interest; and Felgner, P. L. (1990) Advanced Drug Delivery Reviews 5:163-87, for a review of delivery systems useful for gene transfer. Exemplary methods of delivering DNA using electroporation are described in U.S. Pat. Nos. 6,132, 419; 6,451,002, 6,418,341, 6,233,483, U.S. Patent Publication No. 2002/0146831, and International Publication No. WO/0045823, all of which are incorporated herein by reference in their entireties.

Plasmid vectors can also be introduced directly into the heart by injection, as described herein in greater detail with regard to protein administration. Plasmid DNA can be complexed with cationic agents such as polyethyleneimine (PEI) or Lipofectamine 2000 to facilitate uptake. See, e.g., Wang et al. (2005) Mol. Therapy 12(2):314-320. In one embodiment, a plasmid vector encoding titin is complexed with PEI (25 kDa, Sigma-Aldrich, San Diego, Calif.) in a 5% glucose solution at a N/P ratio of approximately 15, where N represents PEI nitrogen and P represents DNA phosphate.

Retroviral Gene Delivery

Retroviruses provide a convenient platform for gene delivery. A selected gene can be inserted into a vector and packaged in retroviral particles using techniques known in the art. The recombinant virus can then be isolated and delivered to cells of the subject either in vivo or ex vivo. A number of retroviral systems have been described. See, e.g., U.S. Pat. No. 5,219,740; Miller and Rosman (1989) BioTechniques 7:980-90; Miller, A. D. (1990) Human Gene Therapy 1:5-14; Scarpa et al. (1991) Virology 180:849-52; Burns et al. (1993) Proc. Natl. Acad. Sci. USA 90:8033-37; Boris-Lawrie and Temin (1993) Curr. Opin. Genet. Develop. 3:102-09.

Replication-defective murine retroviral vectors are widely used gene transfer vectors. Murine leukemia retroviruses include a single stranded RNA molecule complexed with a nuclear core protein and polymerase (pol) enzymes, encased by a protein core (gag), and surrounded by a glycoprotein envelope (env) that determines host range. The genomic structure of retroviruses includes gag, pol, and env genes and 5' and 3' long terminal repeats (LTRs). Retroviral vector systems exploit the fact that a minimal vector containing the 5' and 3' LTRs and the packaging signal are sufficient to allow vector packaging, infection and integration into target cells, provided that the viral structural proteins are supplied in trans in the packaging cell line. Fundamental advantages of retroviral vectors for gene transfer include efficient infection and gene expression in most cell types, precise single copy vector integration into target cell chromosomal DNA and ease of manipulation of the retroviral genome.

Adenoviral Gene Delivery

In one embodiment of the subject invention, a nucleotide sequence encoding titin is inserted into an adenovirus-based expression vector Unlike retroviruses, which integrate into the host genome, adenoviruses persist extrachromosomally thus minimizing the risks associated with insertional mutagenesis (Haj-Ahmad and Graham (1986) J. Virol. 57:267-74; Bett et al. (1993) J. Virol. 67:5911-21; Mittereder et al. (1994) Human Gene Therapy 5:717-29; Seth et al. (1994) J. Virol. 68:933-40; Barr et al. (1994) Gene Therapy 1:51-58; Berkner, K. L. (1988) BioTechniques 6:616-29; and Rich et al. (1993) Human Gene Therapy 4:461-76).

The adenovirus genome is a linear double-stranded DNA molecule of approximately 36,000 base pairs with the 55-kDa terminal protein covalently bound to the 5' terminus of each strand. Adenoviral ("Ad") DNA contains identical Inverted Terminal Repeats ("ITRs") of about 100 base pairs with the exact length depending on the serotype. The viral origins of replication are located within the ITRs exactly at the genome ends.

Adenoviral vectors have several advantages in gene therapy. They infect a wide variety of cells, have a broad host-range, exhibit high efficiencies of infectivity, direct expression of heterologous genes at high levels, and achieve long-term expression of those genes in vivo. The virus is fully infective as a cell-free virion so injection of producer cell lines is not necessary. With regard to safety, adenovirus is not associated with severe human pathology, and the recombinant vectors derived from the virus can be rendered replication defective by deletions in the early-region 1 ("E1") of the viral genome. Adenovirus can also be produced in large quantities with relative ease. For all these reasons vectors derived from human adenoviruses, in which at least the E1 region has been deleted and replaced by a gene of interest, have been used extensively for gene therapy experiments in the pre-clinical and clinical phase.

Adenoviral vectors for use with the present invention can be derived from any of the various adenoviral serotypes, including, without limitation, any of the over 40 serotype strains of adenovirus, such as serotypes 2, 5, 12, 40, and 41. The adenoviral vectors used herein are replication-deficient and contain the gene of interest under the control of a suitable promoter, such as any of the promoters discussed below with reference to adeno-associated virus.

Other recombinant adenoviruses of various serotypes, and comprising different promoter systems, can be created by those skilled in the art. See, e.g., U.S. Pat. No. 6,306,652, incorporated herein by reference in its entirety.

Moreover, "minimal" adenovirus vectors as described in U.S. Pat. No. 6,306,652 will find use with the present invention. Such vectors retain at least a portion of the viral genome required for encapsidation (the encapsidation signal), as well as at least one copy of at least a functional part or a derivative of the ITR. Packaging of the minimal adenovirus vector can be achieved by co-infection with a helper virus or, alternatively, with a packaging-deficient replicating helper system.

Other useful adenovirus-based vectors for delivery of titin gene include the "gutless" (helper-dependent) adenovirus in which the vast majority of the viral genome has been removed. Wu et al. (2001) Anesthes. 94:1119-32. Such "gutless" adenoviral vectors produce essentially no viral proteins, thus allowing gene therapy to persist for over a year after a single administration. Parks (2000) Clin. Genet. 58:1-11; Tsai et al. (2000) Curr. Opin. Mol. Ther. 2:515-23. In addition, removal of the viral genome creates space that can be used to insert control sequences that provide for regulation of transgene expression by systemically administered drugs (Burcin et al. (1999) Proc. Natl. Acad. Sci. USA 96:355-60), adding both safety and control of virally driven protein expression. These and other recombinant adenoviruses will find use with the present methods.

Adeno Associated Virus (AAV) Gene Delivery

One viral system that has been used for gene delivery is AAV. AAV is a parvovirus which belongs to the genus *Dependovirus*. AAV has several attractive features not found in other viruses. First, AAV can infect a wide range of host cells, including non-dividing cells. Second, AAV can infect cells from different species. Third, AAV has not been associated with any human or animal disease and does not appear to alter the biological properties of the host cell upon integration. Indeed, it is estimated that 80-85% of the human population has been exposed to the virus. Finally, AAV is stable at a wide range of physical and chemical conditions, facilitating production, storage and transportation.

The AAV genome is a linear single-stranded DNA molecule containing approximately 4681 nucleotides. The AAV genome generally comprises an internal non-repeating genome flanked on each end by inverted terminal repeats (ITRs). The ITRs are approximately 145 base pairs (bp) in length. The ITRs have multiple functions, including serving as origins of DNA replication and as packaging signals for the viral genome.

The internal non-repeated portion of the genome includes two large open reading frames, known as the AAV replication (rep) and capsid (cap) genes. The rep and cap genes code for viral proteins that allow the virus to replicate and package the viral genome into a virion. In particular, a family of at least four viral proteins is expressed from the AAV rep region, Rep 78, Rep 68, Rep 52, and Rep 40, named according to their apparent molecular weight. The AAV cap region encodes at least three proteins, VP1, VP2, and VP3.

AAV is a helper-dependent virus; that is, it requires co-infection with a helper virus (e.g., adenovirus, herpesvirus or vaccinia) in order to form AAV virions in the wild. In the absence of co-infection with a helper virus, AAV establishes a latent state in which the viral genome inserts into a host cell chromosome, but infectious virions are not produced. Subsequent infection by a helper virus rescues the integrated genome, allowing it to replicate and package its genome into infectious AAV virions. While AAV can infect cells from different species, the helper virus must be of the same species as the host cell. Thus, for example, human AAV will replicate in canine cells co-infected with a canine adenovirus.

Adeno-associated virus (AAV) has been used with success in gene therapy. AAV has been engineered to deliver genes of interest by deleting the internal nonrepeating portion of the AAV genome (i.e., the rep and cap genes) and inserting a heterologous gene (in this case, the gene encoding the anti-inflammatory cytokine) between the ITRs. The heterologous gene is typically functionally linked to a heterologous promoter (constitutive, cell-specific, or inducible) capable of driving gene expression in the patient's target cells under appropriate conditions.

Recombinant AAV virions comprising a titin gene can be produced using a variety of art-recognized techniques. In one embodiment, a rAAV vector construct is packaged into rAAV virions in cells co-transfected with wild-type AAV and a helper virus, such as adenovirus. See, e.g., U.S. Pat. No. 5,139,941.

Alternatively, plasmids can be used to supply the necessary replicative functions from AAV and/or a helper virus. In one embodiment of the present invention, rAAV virions are produced using a plasmid to supply necessary AAV replicative functions (the "AAV helper functions"). See e.g., U.S. Pat. Nos. 5,622,856 and 5,139,941, both incorporated herein by reference in their entireties. In another embodiment, a triple transfection method is used to produce rAAV virions. The triple transfection method is described in detail in U.S. Pat. Nos. 6,001,650 and 6,004,797, which are incorporated by reference herein in their entireties. The triple transduction method is advantageous because it does not require the use of an infectious helper virus during rAAV production, enabling production of a stock of rAAV virions essentially free of contaminating helper virus. This is accomplished by use of three vectors for rAAV virion production: an AAV helper function vector, an accessory function vector, and a rAAV expression vector. One of skill in the art will appreciate, however, that the nucleic acid sequences encoded by these vectors can be provided on two or more vectors in various combinations. Vectors and cell lines necessary for preparing helper virus-free rAAV stocks are commercially available as the AAV Helper-Free System (Catalog No. 240071) (Stratagene, La Jolla, Calif.).

The AAV helper function vector encodes AAV helper function sequences (i.e., rep and cap) that function in trans for productive rAAV replication and encapsidation. Preferably, the AAV helper function vector supports efficient rAAV virion production without generating any detectable replication competent AAV virions (i.e., AAV virions containing functional rep and cap genes). An example of such a vector, pHLP19, is described in U.S. Pat. No. 6,001,650. The rep and cap genes of the AAV helper function vector can be derived from any of the known AAV serotypes. For example, the AAV helper function vector may have a rep gene derived from AAV-2 and a cap gene derived from AAV-6. One of skill in the art will recognize that other rep and cap gene combinations are possible, the defining feature being the ability to support rAAV virion production.

The accessory function vector encodes nucleotide sequences for non-AAV-derived viral and/or cellular functions upon which AAV is dependent for replication (the "accessory functions"). The accessory functions include those functions required for AAV replication, including, without limitation, genes involved in activation of AAV gene transcription, stage specific AAV mRNA splicing, AAV DNA replication, synthesis of cap expression products, and AAV capsid assembly. Viral-based accessory functions can be derived from any of the well-known helper viruses such as adenovirus, herpesvirus (other than herpes simplex virus type-1), and vaccinia virus. In one embodiment, the accessory function plasmid pLadeno5 can be used. See U.S. Pat. No. 6,004,797. This plasmid provides a complete set of adenovirus accessory functions for AAV vector production, but lacks the components necessary to form replication-competent adenovirus.

Unlike stocks of rAAV vectors prepared using infectious helper virus, stocks prepared using an accessory function vector (e.g. the triple transfection method) do not contain contaminating helper virus because no helper virus is added during rAAV production. Even after purification, for example by CsCl density gradient centrifugation, rAAV stocks prepared using helper virus still remain contaminated with some level of residual helper virus. When adenovirus is used as the helper virus in preparing a stock of rAAV virions, contaminating adenovirus can be inactivated by heating to temperatures of approximately 60° C. for 20 minutes or more. This treatment effectively inactivates only the helper virus since AAV is extremely heat stable, while the helper adenovirus is heat labile. Although heat inactivating of rAAV stocks may render much of the contaminating adenovirus non-infectious, it does not physically remove the helper virus proteins from the stock. Such contaminating viral protein can elicit undesired immune responses in subjects and are to be avoided if possible. Contaminating adenovirus particles and proteins in rAAV stocks can be avoided by use of the accessory function vectors disclosed herein.

Recombinant AAV Expression Vectors

Recombinant AAV expression vectors can be constructed using standard techniques of molecular biology. rAAV vectors comprise a transgene of interest (e.g. a gene encoding titin) flanked by AAV ITRs at both ends. rAAV vectors are also constructed to contain transcription control elements operably linked to the transgene sequence, including a transcriptional initiation region and a transcriptional termination region. The control elements are selected to be functional in a mammalian target cell.

The nucleotide sequences of AAV ITR regions are known. See, e.g., Kotin (1994) Human Gene Therapy 5:793-801; Berns "Parvoviridae and their Replication" in Fundamental Virology, 2nd Edition, (B. N. Fields and D. M. Knipe, eds.) for the AAV-2 sequence. AAV ITRs used in the vectors of the invention need not have a wild-type nucleotide sequence, and may be altered, e.g., by the insertion, deletion or substitution of nucleotides. Additionally, AAV ITRs may be derived from any of several AAV serotypes, including without limitation, AAV-1, AAV-2, AAV-3, AAV-4, AAV-5, AAV-6, AAV-7 and AAV-8, etc. Furthermore, 5' and 3' ITRs which flank a selected nucleotide sequence in an AAV expression vector need not necessarily be identical or derived from the same AAV serotype or isolate, so long as they function as intended, i.e., to allow for excision and rescue of the sequence of interest from a host cell genome or vector, and to allow integration of the DNA molecule into the recipient cell genome when AAV Rep gene products are present in the cell.

Suitable transgenes for delivery in AAV vectors will be less than about 5 kilobases (kb) in size. In one embodiment, a complete titin gene can be delivered with AAV vectors. The selected polynucleotide sequence is operably linked to control elements that direct the transcription thereof in the subject in vivo. Such control elements can comprise control sequences normally associated with the selected gene. Alternatively, heterologous control sequences can be employed. Useful heterologous control sequences generally include those derived from sequences encoding mammalian or viral genes. Examples include, but are not limited to, neuron-specific enolase promoter, a GFAP promoter, the SV40 early promoter, mouse mammary tumor virus LTR promoter;

adenovirus major late promoter (Ad MLP); a herpes simplex virus (HSV) promoter, a cytomegalovirus (CMV) promoter such as the CMV immediate early promoter region (CM-VIE), a rous sarcoma virus (RSV) promoter, synthetic promoters, hybrid promoters, and the like. In addition, sequences derived from nonviral genes, such as the murine metallothionein gene, will also find use herein. Such promoter sequences are commercially available from, e.g., Stratagene (San Diego, Calif.).

The AAV expression vector harboring a transgene of interest bounded by AAV ITRs can be constructed by directly inserting the selected sequence(s) into an AAV genome that has had the major AAV open reading frames ("ORFs") excised. Other portions of the AAV genome can also be deleted, so long as enough of the ITRs remain to provide replication and packaging functions. Such constructs can be designed using techniques well known in the art. See, e.g., U.S. Pat. Nos. 5,173,414 and 5,139,941; International Publication Nos. WO 92/01070 and WO 93/03769; Lebkowski et al. (1988) Molec. Cell. Biol. 8:3988-96; Vincent et al. (1990) Vaccines 90 (Cold Spring Harbor Laboratory Press); Carter (1992) Current Opinion in Biotechnology 3:533-39; Muzyczka (1992) Current Topics in Microbiol. and Immunol. 158:97-129; Kotin (1994) Human Gene Therapy 5:793-801; Shelling and Smith (1994) Gene Therapy 1:165-69; and Zhou et al. (1994) J. Exp. Med. 179:1867-75.

AAV ITR-containing DNA fragments can be ligated at both ends of a selected transgene using standard techniques, such as those described in Sambrook et al., supra. For example, ligations can be accomplished in 20 mM Tris-Cl pH 7.5, 10 mM MgCl2, 10 mM DTT, 33 µg/ml BSA, 10 mM-50 mM NaCl, and either 40 µM ATP, 0.01-0.02 (Weiss) units T4 DNA ligase at 0° C. (for "sticky end" ligation) or 1 mM ATP, 0.3-0.6 (Weiss) units T4 DNA ligase at 14° C. (for "blunt end" ligation). Intermolecular "sticky end" ligations are usually performed at 30-100 µg/ml total DNA concentrations (5-100 nM total end concentration).

Suitable host cells for producing rAAV virions of the present invention from rAAV expression vectors include microorganisms, yeast cells, insect cells, and mammalian cells. Such host cells are preferably capable of growth in suspension culture, a bioreactor, or the like. The term "host cell" includes the progeny of the original cell that has been transfected with an rAAV virion. Cells from the stable human cell line, 293 (readily available through the American Type Culture Collection under Accession Number ATCC CRL1573) are preferred in the practice of the present invention. The human cell line 293 is a human embryonic kidney cell line that has been transformed with adenovirus type-5 DNA fragments (Graham et al. (1977) J. Gen. Virol. 36:59), and expresses the adenoviral E1a and E1b genes (Aiello et al. (1979) Virology 94:460). The 293 cell line is readily transfected, and provides a particularly convenient platform in which to produce rAAV virions.

Other Viral Vectors for Gene Delivery

Additional viral vectors useful for delivering the nucleic acid molecules of interest include those derived from the pox family of viruses, including vaccinia virus and avian poxvirus. By way of example, vaccinia virus recombinants expressing a gene of interest can be constructed as follows. DNA carrying the gene is inserted into an appropriate vector adjacent to a vaccinia promoter and flanking vaccinia DNA sequences, such as the sequence encoding thymidine kinase (TK). This vector is then used to transfect cells that are simultaneously infected with vaccinia. Homologous recombination serves to insert the vaccinia promoter and the gene into the viral genome. The resulting TK-recombinant can be selected by culturing the cells in the presence of 5-bromodeoxyuridine and picking viral plaques resistant thereto.

Alternatively, avipoxviruses, such as the fowlpox and canarypox viruses, can be used to deliver the genes. Recombinant avipox viruses expressing immunogens from mammalian pathogens are known to confer protective immunity when administered to non-avian species. The use of avipox vectors in human and other mammalian species is advantageous with regard to safety because members of the avipox genus can only productively replicate in susceptible avian species. Methods for producing recombinant avipoxviruses are known in the art and employ genetic recombination, as described above with respect to the production of vaccinia viruses. See, e.g., WO 91/12882; WO 89/03429; and WO 92/03545.

Molecular conjugate vectors, such as the adenovirus chimeric vectors, can also be used for gene delivery. Michael et al. (1993) J. Biol. Chem. 268:6866-69 and Wagner et al. (1992) Proc. Natl. Acad. Sci. USA 89:6099-6103. Members of the Alphavirus genus, for example the Sindbis and Semliki Forest viruses, may also be used as viral vectors for delivering the TTN gene or a fragment thereof. See, e.g., Dubensky et al. (1996) J. Virol. 70:508-19; WO 95/07995; WO 96/17072.

As used herein, the term "pharmaceutically acceptable" refers to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

As used herein, the term "pharmaceutically acceptable carrier" means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the patient. Some examples of materials which can serve as pharmaceutically-acceptable carriers include: (i) sugars, such as lactose, glucose and sucrose; (ii) starches, such as corn starch and potato starch; (iii) cellulose, and its derivatives, such as sodium carboxymethyl cellulose, methylcellulose, ethyl cellulose, microcrystalline cellulose and cellulose acetate; (iv) powdered tragacanth; (v) malt; (vi) gelatin; (vii) lubricating agents, such as magnesium stearate, sodium lauryl sulfate and talc; (viii) excipients, such as cocoa butter and suppository waxes; (ix) oils, such as peanut oil, cottonseed oil, safflower oil, sesame oil, olive oil, corn oil and soybean oil; (x) glycols, such as propylene glycol; (xi) polyols, such as glycerin, sorbitol, mannitol and polyethylene glycol (PEG); (xii) esters, such as ethyl oleate and ethyl laurate; (xiii) agar; (xiv) buffering agents, such as magnesium hydroxide and aluminum hydroxide; (xv) alginic acid; (xvi) pyrogen-free water; (xvii) isotonic saline; (xviii) Ringer's solution; (xix) ethyl alcohol; (xx) pH buffered solutions; (xxi) polyesters, polycarbonates and/or polyanhydrides; (xxii) bulking agents, such as polypeptides and amino acids (xxiii) serum component, such as serum albumin, HDL and LDL; (xxiv) C2-C12 alchols, such as ethanol; and (xxv) other non-toxic compatible substances employed in pharmaceutical formulations. Wetting agents, coloring agents, release agents, coating agents, sweetening agents, flavoring agents, perfuming agents, preservative and antioxidants can also be present in the formulation.

The term "administer" or "administration" as used herein refers to the placement of a composition into a subject by a method or route which results in at least partial localization of the composition at a desired site such that desired effect is produced, such as intracranially to brain or specific areas of brain. Stereotactic means can be used to guide intracranial administration if desired. Routes of administration suitable for the methods of the invention include both local and systemic administration. Generally, local administration results in more of the composition being delivered to a specific location as compared to the entire body of the subject, whereas, systemic administration can result in delivery to essentially the entire body of the subject. However, it is envisioned that chemotropic property of NSCs can guide the cells to a specific location with a tissue injury, e.g., brain, even with systemic administration.

A composition described herein can be administered by any appropriate route known in the art including, but not limited to, oral or parenteral routes, including intravenous, intramuscular, subcutaneous, transdermal, and nasal administration.

Exemplary modes of administration include, but are not limited to, injection, infusion, instillation, inhalation, or ingestion. "Injection" includes, without limitation, intravenous, intramuscular, intraarterial, intraventricular, intracardiac, intradermal, intraperitoneal, subcutaneous, subcuticular, and intraarticular injection and infusion.

Kits for determining if a subject is at increased risk of developing DCM will include at least one reagent specific for detecting for the presence or absence of the TTN mutations described herein and instructions for observing that the subject is at increased risk of developing DCM if the presence of at least one of the TTN mutations described herein is detected. The kit may optionally include a nucleic acid for detection of the gene of interest.

In some embodiments, the invention also provides assays to identify a subject with an increased risk for developing DCM. In one embodiment, the assay comprises or consists essentially of a system for transforming and identifying at least one TTN mutation described herein in a biological sample of a subject, and a system for computing the likelihood of the subject getting DCM on the basis of comparison of the identified TNN mutation against the DCM-risk associated TTN mutations described herein. If the computing or comparison system, which can be a computer implemented system, indicates that at least one of the TTN mutations described herein is present in the sample, the subject from which the sample is collected can be diagnosed with increased risk for having or developing DCM.

Embodiments of the invention also provide for systems (and computer readable media for causing computer systems) to perform a method for determining presence or absence of TTN mutations associated with an increased risk of a subject for developing DCM. In one embodiment, provided herein is a system comprising: (a) a determination module configured to identify and detect at least one TTN mutation as described herein in a biological sample of a subject; (b) a storage module configured to store output data from the determination module; (c) a computing module adapted to identify from the output data at least one of DCM risk associated TTN mutations is present in the output data stored on the storage module; and (d) a display module for displaying if any of the DCM risk associated TTN mutations was identified or not, and/or displaying the detected TTN mutations.

Embodiments of the invention can be described through functional modules, which are defined by computer executable instructions recorded on computer readable media and which cause a computer to perform method steps when executed. The modules are segregated by function for the sake of clarity. However, it should be understood that the modules/systems need not correspond to discreet blocks of code and the described functions can be carried out by the execution of various code portions stored on various media and executed at various times. Furthermore, it should be appreciated that the modules can perform other functions, thus the modules are not limited to having any particular functions or set of functions.

Figure 9:
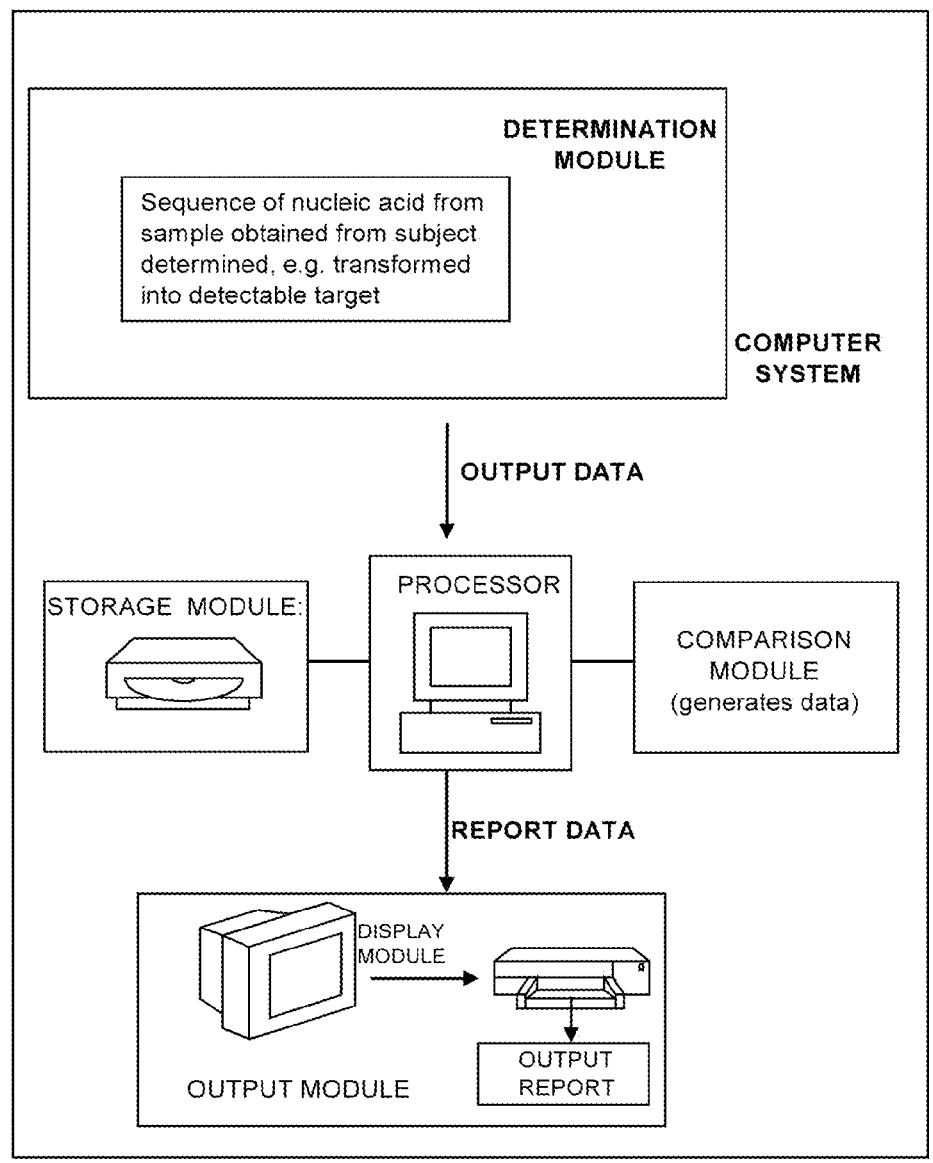
FIG. 9 is a diagram of an embodiment of a system for performing a method for determining whether a subject has an increased risk of having or developing DCM.

In one embodiment, provided herein is a system comprising: (a) at least one memory containing at least one computer program adapted to control the operation of the computer system to implement a method that includes (i) a determination module configured to identify and/or detect the presence or absence of DCM-risk associated mutation in a sample obtained from a subject or the sequence of a nucleic acid comprising a titin-encoding DNA or RNA in a sample obtained from a subject; (ii) a storage module configured to store output data from the determination module; (iii) a computing module adapted to identify from the output data whether the nucleic acid sequence of the sample obtained from the subject differs from SEQ ID NO:1 or comprises a DCM-risk associated mutation as described herein and (iv) a display module for displaying whether the subject has an increased risk of having or developing DCM and/or is in need of treatment for DCM and/or displaying the presence or absence of a DCM-risk associated mutation as described herein (b) at least one processor for executing the computer program (see FIG. 9).

The computer readable storage media can be any available tangible media that can be accessed by a computer. Computer readable storage media includes volatile and nonvolatile, removable and non-removable tangible media implemented in any method or technology for storage of information such as computer readable instructions, data structures, program modules or other data. Computer readable storage media includes, but is not limited to, RAM (random access memory), ROM (read only memory), EPROM (eraseable programmable read only memory), EEPROM (electrically eraseable programmable read only memory), flash memory or other memory technology, CD-ROM (compact disc read only memory), DVDs (digital versatile disks) or other optical storage media, magnetic cassettes, magnetic tape, magnetic disk storage or other magnetic storage media, other types of volatile and nonvolatile memory, and any other tangible medium which can be used to store the desired information and which can accessed by a computer including and any suitable combination of the foregoing.

Computer-readable data embodied on one or more computer-readable media may define instructions, for example, as part of one or more programs that, as a result of being executed by a computer, instruct the computer to perform one or more of the functions described herein, and/or various embodiments, variations and combinations thereof. Such instructions may be written in any of a plurality of programming languages, for example, Java, J#, Visual Basic, C, C#, C++, Fortran, Pascal, Eiffel, Basic, COBOL assembly language, and the like, or any of a variety of combinations thereof. The computer-readable media on which such instructions are embodied may reside on one or more of the components of either of a system, or a computer readable storage medium described herein, may be distributed across one or more of such components.

The computer-readable media may be transportable such that the instructions stored thereon can be loaded onto any computer resource to implement the aspects of the present invention discussed herein. In addition, it should be appreciated that the instructions stored on the computer-readable medium, described above, are not limited to instructions embodied as part of an application program running on a host computer. Rather, the instructions may be embodied as any type of computer code (e.g., software or microcode) that can be employed to program a computer to implement aspects of the present invention. The computer executable instructions may be written in a suitable computer language or combination of several languages. Basic computational biology methods are known to those of ordinary skill in the art and are described in, for example, Setubal and Meidanis et al., Introduction to Computational Biology Methods (PWS Publishing Company, Boston, 1997); Salzberg, Searles, Kasif, (Ed.), Computational Methods in Molecular Biology, (Elsevier, Amsterdam, 1998); Rashidi and Buehler, Bioinformatics Basics: Application in Biological Science and Medicine (CRC Press, London, 2000) and Ouelette and Bzevanis Bioinformatics: A Practical Guide for Analysis of Gene and Proteins (Wiley & Sons, Inc., 2nd ed., 2001).

The functional modules of certain embodiments of the invention include at minimum a determination module, a storage module, a computing module, and a display module. The functional modules can be executed on one, or multiple, computers, or by using one, or multiple, computer networks. The determination module has computer executable instructions to provide e.g., allelic variance etc in computer readable form.

The determination module can comprise any system for detecting a signal elicited from the SNPs described herein in a biological sample. In some embodiments, such systems can include an instrument, e.g., for genotyping such as Pyrosequencer described earlier. In another embodiment, the determination module can comprise multiple units for different functions, such as amplication and hybridization. In one embodiment, the determination module can be configured to perform the genotyping methods described in the Examples, including restriction enzyme digestion, ligation, PCR, purification, labeling, incubation and hybridization.

In some embodiments, the determination module can be further configured to identify and detect the presence of at least one additional DCM risk associated TTN mutation as described above herein.

The information determined in the determination system can be read by the storage module. As used herein the "storage module" is intended to include any suitable computing or processing apparatus or other device configured or adapted for storing data or information. Examples of electronic apparatus suitable for use with the present invention include stand-alone computing apparatus, data telecommunications networks, including local area networks (LAN), wide area networks (WAN), Internet, Intranet, and Extranet, and local and distributed computer processing systems. Storage modules also include, but are not limited to: magnetic storage media, such as floppy discs, hard disc storage media, magnetic tape, optical storage media such as CD-ROM, DVD, electronic storage media such as RAM, ROM, EPROM, EEPROM and the like, general hard disks and hybrids of these categories such as magnetic/optical storage media. The storage module is adapted or configured for having recorded thereon, for example, sample name and TTN mutations, and frequency of each TTN mutation. Such information may be provided in digital form that can be transmitted and read electronically, e.g., via the Internet, on diskette, via USB (universal serial bus) or via any other suitable mode of communication.

As used herein, "stored" refers to a process for encoding information on the storage module. Those skilled in the art can readily adopt any of the presently known methods for recording information on known media to generate manufactures comprising expression level information.

In one embodiment of any of the systems described herein, the storage module stores the output data from the determination module. In additional embodiments, the storage module stores the reference information such as DCM risk associated TTN mutations at the allels described herein, and/or the wild-type sequence in subjects who do not have symptoms associated with DCM.

Figure 10:
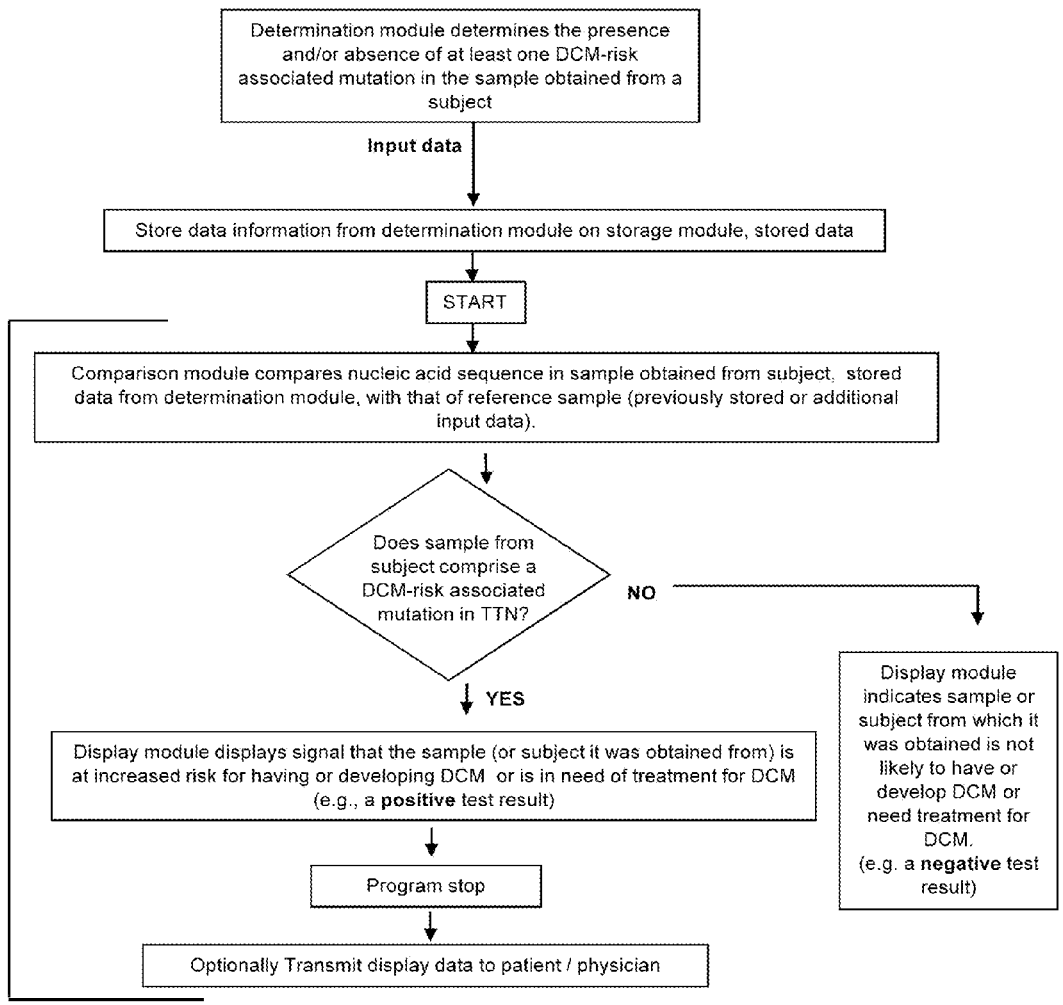
FIG. 10 is a diagram of an embodiment of a comparison module as described herein.

The "computing module" can use a variety of available software programs and formats for computing the presence or absence of at least one TTN mutation described herein and identifying the presence or absence of at least one of DCM risk associated mutation described herein. Genotyping algorithms are well established in the art. A skilled artisan is readily able to determine the appropriate genotyping algorithms based on the size and quality of the sample. Genotyping algorithms, e.g., DM or BRLMM, and statistics tools for data analysis described in Examples can be implemented in the computing module of the invention. In one embodiment, the computing module further comprises a comparison module, which compares the genotype determined at the TTN mutations described herein with the DCM-risk associated TTN mutations and/or wide-type TTN sequence and the comparison module can generate an output indicating undetermined risk for AD. In various embodiments, the comparison module can be configured using existing commercially-available or freely-available software for comparison purpose, and may be optimized for particular data comparisons that are conducted. (see FIG. 10)

Figure 11:
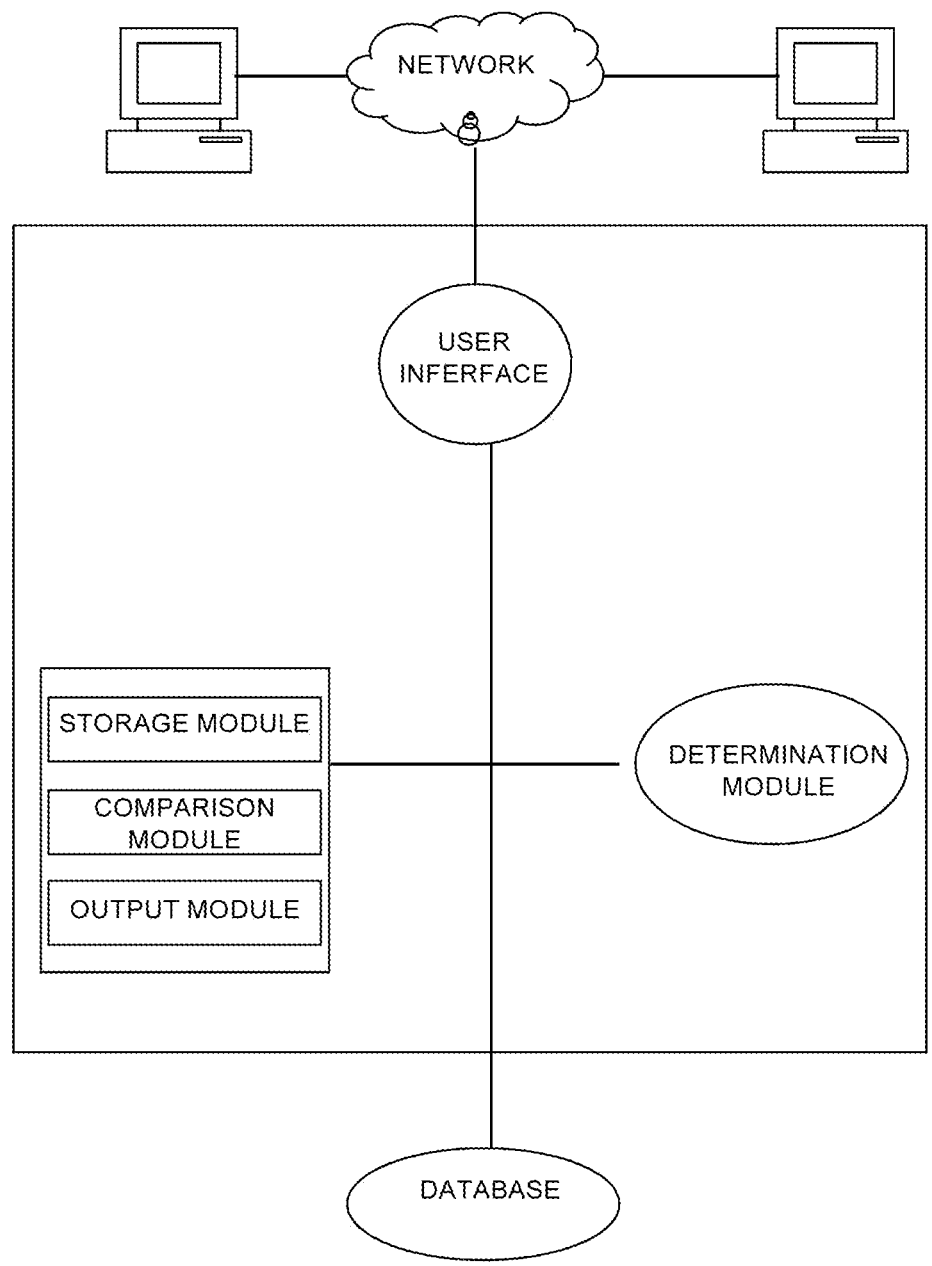
FIG. 11 is a diagram of an embodiment of an operating system and applications for a computing system as described herein.

The computing and/or comparison module, or any other module of the invention, can include an operating system (e.g., UNIX) on which runs a relational database management system, a World Wide Web application, and a World Wide Web server. World Wide Web application includes the executable code necessary for generation of database language statements (e.g., Structured Query Language (SQL) statements). Generally, the executables will include embedded SQL statements. In addition, the World Wide Web application may include a configuration file which contains pointers and addresses to the various software entities that comprise the server as well as the various external and internal databases which must be accessed to service user requests. The Configuration file also directs requests for server resources to the appropriate hardware—as may be necessary should the server be distributed over two or more separate computers. In one embodiment, the World Wide Web server supports a TCP/IP protocol. Local networks such as this are sometimes referred to as "Intranets." An advantage of such Intranets is that they allow easy communication with public domain databases residing on the World Wide Web (e.g., the GenBank or Swiss Pro World Wide Web site). Thus, in a particular preferred embodiment of the present invention, users can directly access data (via Hypertext links for example) residing on Internet databases using a HTML interface provided by Web browsers and Web servers (FIG. 11).

The computing and/or comparison module provides a computer readable comparison result that can be processed in computer readable form by predefined criteria, or criteria defined by a user, to provide a content-based in part on the comparison result that may be stored and output as requested by a user using an output module, e.g., a display module.

In some embodiments, the content displayed on the display module can be a genotype identified in the biological sample of the subject together with a reference sequence. For example, the reference sequence can be a DCM-risk associated TTN mutation or a wild-type TTN sequence. In some embodiments, the content displayed on the display module can be a numerical value indicating the probability of developing DCM. In such embodiments, the probability can be expressed in percentages or a fraction of developing DCM. For example, higher percentage or a fraction closer to 1 indicates a higher likelihood of a subject going to to be affected by DCM. In some embodiments, the content displayed on the display module can be single word or phrases to quanlitatively indicate the likelihood of a subject going to be affected with DCM. For example, a word "unlikely" can be used to indicate a lower risk for DCM, while "likely" can be used to indicate a high risk for DCM.

In one embodiment of the invention, the content based on the computing and/or comparison result is displayed on a computer monitor. In one embodiment of the invention, the content based on the computing and/or comparison result is displayed through printable media. The display module can be any suitable device configured to receive from a computer and display computer readable information to a user. Non-limiting examples include, for example, general-purpose computers such as those based on Intel PENTIUM-type processor, Motorola PowerPC, Sun UltraSPARC, Hewlett-Packard PA-RISC processors, any of a variety of processors available from Advanced Micro Devices (AMD) of Sunnyvale, Calif., or any other type of processor, visual display devices such as flat panel displays, cathode ray tubes and the like, as well as computer printers of various types.

In one embodiment, a World Wide Web browser is used for providing a user interface for display of the content based on the computing/comparison result. It should be understood that other modules of the invention can be adapted to have a web browser interface. Through the Web browser, a user can construct requests for retrieving data from the computing/comparison module. Thus, the user will typically point and click to user interface elements such as buttons, pull down menus, scroll bars and the like conventionally employed in graphical user interfaces.

Systems and computer readable media described herein are merely illustrative embodiments of the invention for identifying at least one TTN mutation described herein in a subject and determining a risk of the subject for developing DCM, and therefore are not intended to limit the scope of the invention. Variations of the systems and computer readable media described herein are possible and are intended to fall within the scope of the invention.

The modules of the machine, or those used in the computer readable medium, may assume numerous configurations. For example, function may be provided on a single machine or distributed over multiple machines.

Methods and compositions described herein relating to determining if a subject is at increased risk of having or developing DCM can relate to determining the presence of a TTN mutation in a sample obtained from the subject. In some embodiments, the sample is a nucleic acid sample. A sample obtained from a subject can be a biological sample. "Biological sample" as used herein denotes a sample taken or isolated from a biological organism, e.g., tissue cell culture supernatant, cell lysate, a homogenate of a tissue sample from a subject or a fluid sample from a subject. Exemplary biological samples include, but are not limited to, blood, sputum, urine, spinal fluid, pleural fluid, nipple aspirates, lymph fluid, the external sections of the skin, respiratory, intestinal, and genitourinary tracts, tears, saliva, milk, feces, sperm, cells or cell cultures, serum, leukocyte fractions, smears, tissue samples of all kinds, embryos, etc and mixtures or combinations thereof. The term "biological sample" also includes untreated or pretreated (or pre-processed) biological samples.

A "biological sample" can contain cells from subject, but the term can also refer to non-cellular biological material, such as non-cellular fractions of blood, saliva, or urine, that can be used to determine the presence of a TTN mutation as described herein. In some embodiments, the sample is from a resection, biopsy, or core needle biopsy. In addition, fine needle aspirate samples can be used. Samples can be either paraffin-embedded or frozen tissue.

The sample can be obtained by removing a sample of cells from a subject, but can also be accomplished by using previously isolated cells (e.g. isolated by another person). In addition, the biological sample can be freshly collected or a previously collected sample. Furthermore, the biological sample can be utilized for the detection of the presence and/or quantitative level of a biomolecule of interest. Representative biomolecules include, but are not limited to, DNA, RNA, mRNA, polypeptides, and derivatives and fragments thereof. In some embodiments, the biological sample can be used for TTN mutation determination for diagnosis of a disease or a disorder, e.g., DCM, using the methods, assays and systems of the invention.

In some embodiments, biological sample is a biological fluid. Examples of biological fluids include, but are not limited to, saliva, bone marrow, blood, serum, plasma, urine, sputum, cerebrospinal fluid, an aspirate, tears, and any combinations thereof.

In some embodiments, the biological sample is an untreated biological sample. As used herein, the phrase "untreated biological sample" refers to a biological sample that has not had any prior sample pre-treatment except for dilution and/or suspension in a solution. Exemplary methods for treating a biological sample include, but are not limited to, centrifugation, filtration, sonication, homogenization, heating, freezing and thawing, and any combinations thereof.

In some embodiments, the biological sample is a frozen biological sample, e.g., a frozen tissue or fluid sample such as urine, blood, serum or plasma. The frozen sample can be thawed before employing methods, assays and systems of the invention. After thawing, a frozen sample can be centrifuged before being subjected to methods, assays and systems of the invention.

In some embodiments, the biological fluid sample can be treated with at least one chemical reagent, such as a nuclease inhibitor. In some embodiments, the biological fluid sample is a clarified biological fluid sample, for example, by centrifugation and collection of a supernatant comprising the clarified biological fluid sample.

In some embodiments, a biological sample is a pre-processed biological sample, for example, supernatant or filtrate resulting from a treatment selected from the group consisting of centrifugation, filtration, sonication, homogenization, lysis, thawing, amplification, purification, restriction enzyme digestion ligation and any combinations thereof. In some embodiments, a biological sample can be a nucleic acid product amplified after polymerase chain reaction (PCR). The term "nucleic acid" used herein refers to DNA, RNA, or mRNA.

In some embodiments, the biological sample can be treated with a chemical and/or biological reagent. Chemical and/or biological reagents can be employed to protect and/or maintain the stability of the sample, including biomolecules (e.g., nucleic acid and protein) therein, during processing. One exemplary reagent is a protease inhibitor, which is generally used to protect or maintain the stability of protein during processing. In addition, or alternatively, chemical and/or biological reagents can be employed to release nucleic acid or protein from the sample.

The skilled artisan is well aware of methods and processes appropriate for pre-processing of biological samples required for determination of TTN mutations as described herein.

Nucleic acid and ribonucleic acid (RNA) molecules can be isolated from a particular biological sample using any of a number of procedures, which are well-known in the art, the particular isolation procedure chosen being appropriate for the particular biological sample. For example, freeze-thaw and alkaline lysis procedures can be useful for obtaining nucleic acid molecules from solid materials; heat and alkaline lysis procedures can be useful for obtaining nucleic acid molecules from urine; and proteinase K extraction can be used to obtain nucleic acid from blood (Roiff, A et al. PCR: Clinical Diagnostics and Research, Springer (1994)).

The invention can be further illustrated by any of the following numbered paragraphs:

1. An assay for determining if a subject has an increased risk for developing a dilated cardiomyopathy (DCM) or increased risk for heart failure or is in need of treatment for DCM, the assay comprising:
   (i) sequencing at least a portion of TTN gene in a sample from a human subject to detect a TTN nucleic acid which results in a truncated TITIN polypeptide; and
   (ii) detecting if any such mutation is present in the nucleic acid sample,
   wherein detection of the presence of at least one said mutation is indicative of the subject having an increased risk for developing DCM.

2. The assay of paragraph 1, wherein said nucleic acid sequencing is dideoxy sequencing, Maxam-Gilbert sequencing, dye-terminator sequencing, Lynx Therapeutics' Massively Parallel Sequencing (MPSS) Polony sequencing, 454 Pyrosequencing, Illumina (Solexa) sequencing, Single Molecule real time (RNAP) sequencing, Nanaopore DNA sequencing, or sequencing by technology from VisiGen Biotechnologies.

3. The assay of paragraph 1 or 2, wherein the truncated TITIN polypeptide lacks part of the A-band, having a wild-type sequence set forth in SEQ ID NO: 725.

4. The assay of any of paragraphs 1-3, wherein said TTN nucleic acid mutation is selected from the group consisting of 6247_6247delG, 12745C>T, 14470_14471insCACACTCCATA (SEQ ID NO: 722), 19183_19183delG, 23798_23810delGTCAAGATATCTG (SEQ ID NO: 723), 38621_38622insA, 44336_44336delA, 45322_45322del1, 49077G>A, 51883C>T, 52408C>T, 53145_53146insG, 53347G>T, 53935_53935delC, 56367T>A, 56572C>T, 56953C>T, 58678C>T, 59530C>T, 61046_61046delC, 65867_65867delA, 67057_67063delGCATATGinsTA, 67745_67745delT, 72178_72179insT, 72723_72739delinsAGA, 77065C>T, 79896G>A, 80845C>T, 81046A>T, 81440G>A, 81536_81537delCT, 82701C>A, 84977_84980delATTA, 87953G>A, 88242C>T, 88528G>T, 89177_89181delAAATT, 90241C>T, 91042_91042delA, 91537_91538insA, 94111A>T, 95522C>A, 30476-1G>A, 34186+1G>T, 35635G>C, 35635+1G>A, 44725+2delT, 48364+1G>T, 50346_+3A>G, 54422-5T>A, 54704-1G>A, 55003+1G>A, 62425+5G>A, 63405A>G, 64489+1G>A, 81898+2T>A, 92569+1G>C, and any combination thereof, wherein the mutation location is determined based upon the wildtype TTN sequence having a nucleic acid sequence set forth in SEQ ID NO: 1.

5. The assay of any of paragraphs 1-4, wherein said sequencing comprises contacting the nucleic acid sample with a probe or primer.

6. The assay of any of paragraphs 1-5, wherein the subject is one who exhibits one or more risk factors for DCM or one or more complications related to DCM or a subject who does not exhibit risk factors or a subject who is a family member of an individual who has been diagnosed with a cardiac condition.

7. The assay of any of paragraphs 1-6, wherein the subject is asymptomatic.

8. The assay of any of paragraphs 1-7, wherein dilated cardiomyopathy is idiopathic dilated cardiomyopathy.

9. A method of treating a subject for dilated cardiomyopathy, comprising:
   (i) selecting a subject at risk for developing DCM or in need of treatment for DCM using an assay of paragraph 1; and
   (ii) administering a treatment for DCM to the subject.

10. The method of paragraph 9, wherein the treatment is selected from the group consisting of angiotensin-converting enzyme (ACE) inhibitors, angiotensin II receptor blockers, beta blockers, diuretics, aldosterone antagonists, digoxin (Lanoxin), blood thinning medications, biventricular pacemakers, implantable cardioverter-defibrillators (ICDs), heart pumps (left ventricular assist devices, or LVADs), heart transplant, gene therapy, calcium channel blockers, tissue growth factor inhibitors, and any combinations thereof.

11. An in vitro assay comprising:
    (iii) contacting a nucleic acid sample obtained from a subject with a probe, wherein the probe is capable of detecting a mutation resulting in a truncated TITIN polypeptide;
    (iv) detecting the presence of the mutation in the nucleic acid sample,
    wherein detection of the presence of at least one said mutation is indicative of the subject having an increased risk for developing DCM.

12. The assay of paragraph 11, wherein the probe is a sequencing primer.

13. An in vitro assay for determining if a subject has an increased risk for developing a dilated cardiomyopathy (DCM), the assay comprising:
    (i) transforming a portion of a titin (TTN) nucleic acid in a sample obtained from the subject into at least one detectable target;
    (ii) detecting presence or absence of at least one mutation in the TTN nucleic acid, wherein the at least one mutation in the TTN nucleic acid results in a truncated TITIN polypeptide
    wherein detection of the presence of at least one of the mutation is indicative of the subject having an increased risk for developing DCM.

14. An in vitro assay for determining if a subject is need of treatment for DCM, the method comprising:
    (i) sequencing at least a portion of TTN gene in a sample from a human subject;

(ii) comparing the sequence obtained in step (i) with wild type TTN gene sequence having a nucleic acid sequence set forth in SEQ ID NO: 1; and (iii) determining if the variation is one or more which results in a truncated (shortened) TITIN polypeptide; and wherein detection of at least one of the variations is indicative of subject is in need of treatment for DCM.

15. The in vitro assay of paragraph 14, further comprising administering a treatment for DCM to the subject, if presence of at least one the variations is detected.

16. The in vitro assay of any of paragraphs 11-15, wherein the truncated TITIN polypeptide lacks part of the A-band, having a wild-type sequence set forth in SEQ ID NO: 725.

17. The in vitro assay of any of paragraphs 11-16, wherein the mutation is selected from the group consisting of 6247_6247delG, 12745C>T, 14470_14471insCACACTCCATA (SEQ ID NO: 722), 19183_19183delG, 23798_23810delGTCAAGATATCTG (SEQ ID NO: 723), 38621_38622insA, 44336_44336delA, 45322_45322delT, 49077G>A, 51883C>T, 52408C>T, 53145_53146insG, 53347G>T, 53935_53935delC, 56367T>A, 56572C>T, 56953C>T, 58678C>T, 59530C>T, 61046_61046delC, 65867_65867delA, 67057_67063delGCATATGinsTA, 67745_67745delT, 72178_72179insT, 72723_72739delinsAGA, 77065C>T, 79896G>A, 80845C>T, 81046A>T, 81440G>A, 81536_81537delCT, 82701C>A, 84977_84980delATTA, 87953G>A, 88242C>T, 88528G>T, 89177_89181delAAATT, 90241C>T, 91042_91042delA, 91537_91538insA, 94111A>T, 95522C>A, 30476-1G>A, 34186+1G>T, 35635G>C, 35635+1G>A, 44725+2delT, 48364+1G>T, 50346_+3A>G, 54422-5T>A, 54704-1G>A, 55003+1G>A, 62425+5G>A, 63405A>G, 64489+1G>A, 81898+2T>A, 92569+1G>C, and any combination thereof, wherein the mutation location is determined based upon the wildtype TTN sequence having a nucleic acid sequence set forth in SEQ ID NO: 1.

18. The in vitro assay of any of paragraphs 11-17, wherein the step of detecting the mutation is performed by nucleic acid sequencing.

19. The in vitro assay of paragraph 18, wherein said nucleic acid sequencing is Maxam-Gilbert sequencing, dye-terminator sequencing, Lynx Therapeutics' Massively Parallel Sequencing (MPSS) Polony sequencing, 454 Pyrosequencing, Illumina (Solexa) sequencing, Single Molecule real time (RNAP) sequencing, Nanaopore DNA sequencing, or sequencing by technology from VisiGen Biotechnologies.

20. The in vitro assay of any of paragraph 11-19, wherein detection of the mutation is by a computer implemented system.

21. The in vitro assay of any of paragraphs 11-20, further comprising the step of displaying the result on a display module.

22. The in vitro assay of any of paragraphs 11-21, wherein dilated cardiomyopathy is idiopathic dilated cardiomyopathy or heart failure or any other related cardiomyopathy.

23. The in vitro assay of any of paragraphs 11-22, wherein the subject is one who exhibits one or more risk factors for DCM or one or more complications related to DCM or a subject who does not exhibit risk factors or a subject who is a family member of an individual who has been diagnosed with a cardiac condition.

24. The in vitro assay of any of paragraphs 11-23, wherein the subject is asymptomatic.

25. A method of treating a subject for dilated cardiomyopathy, comprising:
(iii) selecting a subject at risk for developing DCM or in need of treatment for DCM using an in vitro assay of any of paragraphs 11-24; and
(iv) administering a treatment for DCM to the subject.

26. The method of paragraph 25, wherein the treatment is selected from the group consisting of angiotensin-converting enzyme (ACE) inhibitors, angiotensin II receptor blockers, beta blockers, diuretics, aldosterone antagonists, digoxin (Lanoxin), blood thinning medications, biventricular pacemakers, implantable cardioverter-defibrillators (ICDs), heart pumps (left ventricular assist devices, or LVADs), heart transplant, gene therapy, calcium channel blockers, tissue growth factor inhibitors, and any combinations thereof.

27. The method of paragraph 26, wherein the treatment comprises administering to said subject a polypeptide comprising amino acid SEQ ID NO: 2 or a nucleic acid encoding a polypeptide comprising amino acid SEQ ID NO: 2.

28. The method of paragraph 27, wherein the nucleic acid encoding the polypeptide of amino acid SEQ ID NO: 2 is operably linked to a vector.

29. The method any of paragraphs 25-28, wherein the subject is one who exhibits one or more risk factors for DCM or one or more complications related to DCM or a subject who does not exhibit risk factors or a subject who is a family member of an individual who has been diagnosed with a cardiac condition.

30. The method of any of paragraphs 25-29, wherein the subject is asymptomatic.

31. A method comprising administering a treatment for dilated cardiomyopathy to a subject determined to have a mutation in TTN gene which results in a truncated TITIN polypeptide.

32. The method of paragraph 31, wherein the truncated TITIN polypeptide lacks part of the A-band, having a wild-type sequence set forth in SEQ ID NO: 725.

33. The method of paragraph 31 or 32, wherein the mutation is selected from the group consisting of 6247_6247delG, 12745C>T, 14470_14471insCACACTCCATA (SEQ ID NO: 722), 19183_19183delG, 23798_23810delGTCAAGATATCTG (SEQ ID NO: 723), 38621_38622insA, 44336_44336delA, 45322_45322delT, 49077G>A, 51883C>T, 52408C>T, 53145_53146insG, 53347G>T, 53935_53935delC, 56367T>A, 56572C>T, 56953C>T, 58678C>T, 59530C>T, 61046_61046delC, 65867_65867delA, 67057_67063delGCATATGinsTA, 67745_67745delT, 72178_72179insT, 72723_72739delinsAGA, 77065C>T, 79896G>A, 80845C>T, 81046A>T, 81440G>A, 81536_81537delCT, 82701C>A, 84977_84980delATTA, 87953G>A, 88242C>T, 88528G>T, 89177_89181delAAATT, 90241C>T, 91042_91042delA, 91537_91538insA, 94111A>T, 95522C>A, 30476-1G>A, 34186+1G>T, 35635G>C, 35635+1G>A, 44725+2delT, 48364+1G>T, 50346_+3A>G, 54422-5T>A, 54704-1G>A, 55003+1G>A, 62425+5G>A, 63405A>G, 64489+1G>A, 81898+2T>A, 92569+1G>C, and any combination thereof, wherein the mutation location is determined based upon the wildtype TTN sequence having a nucleic acid sequence set forth in SEQ ID NO: 1.

34. The method any of paragraphs 31-33, wherein detection of the mutation is by nucleic acid sequencing.

35. The assay of paragraph 34, wherein said nucleic acid sequencing is Maxam-Gilbert sequencing, dye-terminator sequencing, Lynx Therapeutics' Massively Parallel Sequencing (MPSS) Polony sequencing, 454 Pyrosequencing, Illumina (Solexa) sequencing, SOLiD™ sequencing, Single Molecule SMART™ sequencing, Single Molecule real time (RNAP) sequencing, Nanaopore DNA sequencing, or sequencing by technology from VisiGen Biotechnologies.

36. The assay of any of paragraph 31-35, wherein detection of the mutation is by a computer implemented system.

37. The assay of any of paragraphs 31-36, further comprising the step of displaying the detection of the mutation on a display module.

38. The assay of any of paragraphs 31-37, wherein dilated cardiomyopathy is idiopathic dilated cardiomyopathy.

39. The assay of any of paragraphs 31-38, wherein the subject is one who exhibits one or more risk factors for DCM or one or more complications related to DCM or a subject who does not exhibit risk factors or a subject who is a family member of an individual who has been diagnosed with a cardiac condition.

40. The assay of any of paragraphs 31-39, wherein the subject is asymptomatic.

41. A computer implemented system for determining presence or absence of nucleic acid mutation associated with an increased risk of a subject for developing DCM, the system comprising:
  (i) a determination module configured to identify and detect at least one nucleic acid mutation in TTN gene of SEQ ID NO: 1, wherein the nucleic acid mutation is selected from the group consisting of 6247_6247delG, 12745C>T, 14470_14471insCACACTCCATA (SEQ ID NO: 722), 19183_19183delG, 23798_23810delGTCAAGATATCTG (SEQ ID NO: 723), 38621_38622insA, 44336_44336delA, 45322_45322delT, 49077G>A, 51883C>T, 52408C>T, 53145_53146insG, 53347G>T, 53935_53935delC, 56367T>A, 56572C>T, 56953C>T, 58678C>T, 59530C>T, 61046_61046delC, 65867_65867delA, 67057_67063delGCATATGinsTA, 67745_67745delT, 72178_72179insT, 72723_72739delinsAGA, 77065C>T, 79896G>A, 80845C>T, 81046A>T, 81440G>A, 81536_81537delCT, 82701C>A, 84977_84980delATTA, 87953G>A, 88242C>T, 88528G>T, 89177_89181delAAATT, 90241C>T, 91042_91042delA, 91537_91538insA, 94111A>T, 95522C>A, 30476-1G>A, 34186+1G>T, 35635G>C, 35635+1G>A, 44725+2delT, 48364+1G>T, 50346_+3A>G, 54422-5T>A, 54704-1G>A, 55003+1G>A, 62425+5G>A, 63405A>G, 64489+1G>A, 81898+2T>A, 92569+1G>C, and any combination thereof;
  (ii) a storage module configured to store output data from the determination module;
  (iii) a computing module adapted to identify from the output data at least one of DCM risk associated mutation is present in the output data stored on the storage module; and
  (iv) a display module for displaying if any of the DCM risk associated mutation was identified or not, and/or displaying the detected mutation.

42. The computer implemented system of paragraph 41, wherein the determination module comprises a system that transforms any nucleic acid or mutation therein into a detectable molecule.

43. The computer implemented system of paragraph 42, further comprising a system that detects the detectable molecule.

44. The computer implemented system of any of paragraphs 41-43, wherein the determination module comprises a system for contacting a nucleic acid sample obtained from a subject with a probe, wherein the probe is capable of detecting the TTN nucleic acid mutation.

Unless stated otherwise, or implicit from context, the following terms and phrases include the meanings provided below. Unless explicitly stated otherwise, or apparent from context, the terms and phrases below do not exclude the meaning that the term or phrase has acquired in the art to which it pertains. The definitions are provided to aid in describing particular embodiments, and are not intended to limit the claimed invention, because the scope of the invention is limited only by the claims. Further, unless otherwise required by context, singular terms shall include pluralities and plural terms shall include the singular.

As used herein the term "comprising" or "comprises" is used in reference to compositions, methods, and respective component(s) thereof, that are useful to the invention, yet open to the inclusion of unspecified elements, whether useful or not.

The singular terms "a," "an," and "the" include plural referents unless context clearly indicates otherwise. Similarly, the word "or" is intended to include "and" unless the context clearly indicates otherwise.

As used herein, the term "about" means 2.5% of the value being referred to. For example, about 10 means from 7.5 to 12.5.

Although methods and materials similar or equivalent to those described herein can be used in the practice or testing of this disclosure, suitable methods and materials are described below. The term "comprises" means "includes." The abbreviation, "e.g." is derived from the Latin exempli gratia, and is used herein to indicate a non-limiting example. Thus, the abbreviation "e.g." is synonymous with the term "for example."

The terms "decrease", "reduced", "reduction", "decrease" or "inhibit" are all used herein generally to mean a decrease by a statistically significant amount. However, for avoidance of doubt, "reduced", "reduction" or "decrease" or "inhibit" means a decrease by at least 10% as compared to a reference level. In some embodiments, decrease can be at least about 20%, or at least about 30%, or at least about 40%, or at least about 50%, or at least about 60%, or at least about 70%, or at least about 80%, or at least about 90% or up to and including a 100% decrease (e.g. absent level as compared to a reference sample), or any decrease between 10-100% as compared to a reference level.

The terms "increased", "increase" or "enhance" or "activate" are all used herein to generally mean an increase by a statically significant amount; for the avoidance of any doubt, the terms "increased", "increase" or "enhance" or "activate" means an increase of at least 10% as compared to a reference level. In some embodiments, increase can be at least about 20%, or at least about 30%, or at least about 40%, or at least about 50%, or at least about 60%, or at least about 70%, or at least about 80%, or at least about 90% or up to and including a 100% increase or any increase between 10-100% as compared to a reference level, or at least about a 2-fold, or at least about a 3-fold, or at least about a 4-fold, or at least about a 5-fold or at least about a 10-fold increase, or any increase between 2-fold and 10-fold or greater as compared to a reference level.

The term "statistically significant" or "significantly" refers to statistical significance and generally means at least two standard deviation (2SD) away from a reference level. The term refers to statistical evidence that there is a difference. It is defined as the probability of making a decision to reject the null hypothesis when the null hypothesis is actually true.

The disclosure is further illustrated by the following examples which should not be construed as limiting. The examples are illustrative only, and are not intended to limit, in any manner, any of the aspects described herein. The following examples do not in any way limit the invention.

EXAMPLES

Example 1

Truncation of Titin Causing Dilated Cardiomyopathy

Dilated cardiomyopathy (DCM) and hypertrophic cardiomyopathy (HCM) arise from mutations in many genes. The TTN gene, which encodes the sarcomere protein titin, has been insufficiently interrogated for cardiomyopathy mutations because of its enormous size.

TTN was analyzed in 312 DCM subjects, 231 HCM subjects, and 249 control subjects using next-generation or dideoxy sequencing. Deleterious variants were evaluated for co-segregation in families and assessed clinical characteristics.

Seventy two mutations were identified (25 nonsense, 23 frameshift, 23 splicing, and one large tandem insertion) that altered full-length titin. Among subjects studied by next-generation sequencing, TTN mutations were strongly enriched in DCM (54 of 203; 27%) versus HCM (3 of 231; 1.3%; P=$3\times10^{-16}$) or control subjects (7 of 249; 2.8%; P=$9\times10^{-14}$). TTN mutations co-segregated with DCM in families (combined LOD score=11.1) with high (>95%) penetrance after the age of 40 years. DCM mutations were overrepresented in the A-band but absent from the Z-disk and M-band regions of titin (P≤0.01). Overall, cardiac outcomes were similar in subjects with and without TTN mutations, but adverse events occurred earlier in male than female mutation carriers (P=$4\times10^{-5}$).

TTN truncating mutations are a common cause of DCM, occurring in approximately 25% of familial and 18% of sporadic idiopathic DCM. Incorporation of next-generation sequencing approaches that detect TTN truncations into DCM genetic testing should substantially increase test sensitivity, thereby enabling earlier diagnosis and therapeutic intervention for many DCM subjects. Defining the functional impact of TTN truncating mutations should improve understanding of DCM pathophysiology.

Gene mutation is an important cause of cardiomyopathy. Mutations in eight sarcomere protein genes cause hypertrophic cardiomyopathy (HCM) and are detected in 40 to 70% of HCM patients[1,2]. Variations in over 40 genes, most of which encode components of the sarcomere, the cytoskeleton, or the nuclear lamina, have been demonstrated or posited to cause dilated cardiomyopathy (DCM)[3,4]. Clinical evaluation identifies affected or likely-affected family members in 30 to 50% of DCM cases[5-7], implicating a genetic etiology, but pathogenic mutations have been found in only 20 to 30% of cases[8].

TTN, the gene encoding titin, has been implicated in cardiomyopathy, but has been incompletely studied due to technical challenges posed by the monumental size of its coding sequence (~100 kb). TTN mutations have been definitively linked to DCM in 3 families[9-11], but not to HCM. Additionally, TTN mutations have been implicated in congenital myopathies involving cardiac and skeletal muscle, hereditary myopathy with early respiratory failure, tibial muscular dystrophy, and limb-girdle muscular dystrophy[12-15].

Titin is the largest human protein (~33,000 amino acids) and the third most abundant striated muscle protein[16]. Two titin molecules together span the sarcomere (~2 μLB) and are anchored at the Z-line and M-line (FIG. 1)[17]. Titin is necessary for sarcomere assembly[18,19], provides the majority of passive force[20,21] and modulates active contractile force[22,23]. There are many different isoforms of titin, which in the heart are classified predominantly as N2B and N2BA (FIG. 1)[24]. TTN also encodes a separate cardiac isoform, novex-3 titin, which is only 5,600 amino acid, lacks the A-band and M-band segments of titin[25] and is less abundant in cardiac tissue than full-length titin.

Filter-based hybridization capture followed by next-generation sequencing[26] or traditional dideoxy sequencing was undertaken to assess the contribution of TTN mutations to cardiomyopathies, analyzing 312 subjects with idiopathic DCM, 231 subjects with HCM, and 249 control subjects.

Materials and Methods

Subjects:

Studies were performed according to institutional guidelines and human tissue act UK guidelines or local ethics committee approval. Idiopathic DCM subjects were studied from three cohorts (Table 5): 92 subjects recruited at Brigham and Women's Hospital (BWH) (DCM-A); 71 subjects recruited during cardiac transplant evaluation at the Royal Brompton and Harefield NHS Trust (DCM-B); and 149 subjects prospectively recruited in Colorado or Italy into a Familial Dilated Cardiomyopathy Registry (DCM-C). DCM-A and DCM-C cohorts were enriched for familial disease. HCM subjects (N=231) were recruited at BWH or the Mayo Clinic. DCM and HCM subjects were diagnosed using published criteria[27,28]. Control subjects (N=249) without cardiomyopathy were recruited from multiple sites. No subjects within cohorts had a known familial relationship.

Dna Sequencing And Genotyping

Genomic DNA isolated from DCM-A, DCM-B, HCM, and control subjects were used to construct DNA libraries. DNA libraries were then enriched for TTN using filter-based hybridization capture[26] with minor modifications (Tables 3, 4) and studied by single- or paired-end sequencing using an Illumina Genome Analyzer II or HiSeq[29]. TTN sequence was assessed in DCM-C subjects by traditional Sanger dideoxy sequencing, performed by the University of Washington, Department of Genome Sciences.

Dna Sequence Analyses:

Next-generation sequence data was analyzed using a custom pipeline integrating existing tools, including NOVALIGN™ (http://www.novocraft.com) and the GENOME ANALYSIS TOOLKIT™[30], and Perl (using Bio-Samtools) and R[31] scripts. Primary analyses of TTN variations were performed among subjects studied by the same approach (Table 1) to control for differences in variant detection. The amino acid positions of titin variants were identified using the UniProt titin sequence (Q8WZ42) and mutations were reported using Human Genome Variation Society nomenclature (Table 6). Variant confirmation and genotyping was performed by polymerase-chain reaction amplification followed by dideoxy sequencing, restriction digestion, gel electrophoresis[26] and/or RNA sequencing of cardiac tissue[32].

Statistical Analyses:

Association and cross-cohort analyses were performed using Fisher's exact tests, exact conditional tests of independence, or goodness of fit tests unless otherwise specified. The uniformity of the spatial distribution of mutations was assessed using a chi-square goodness of fit test, incorporating the size of each region. The clinical characteristics of subsets of each cohort were compared using two-tailed, unpaired t-tests. Kaplan-Meier curves were computed using software survfit and compared using coxph in R[31].

Figure 5:
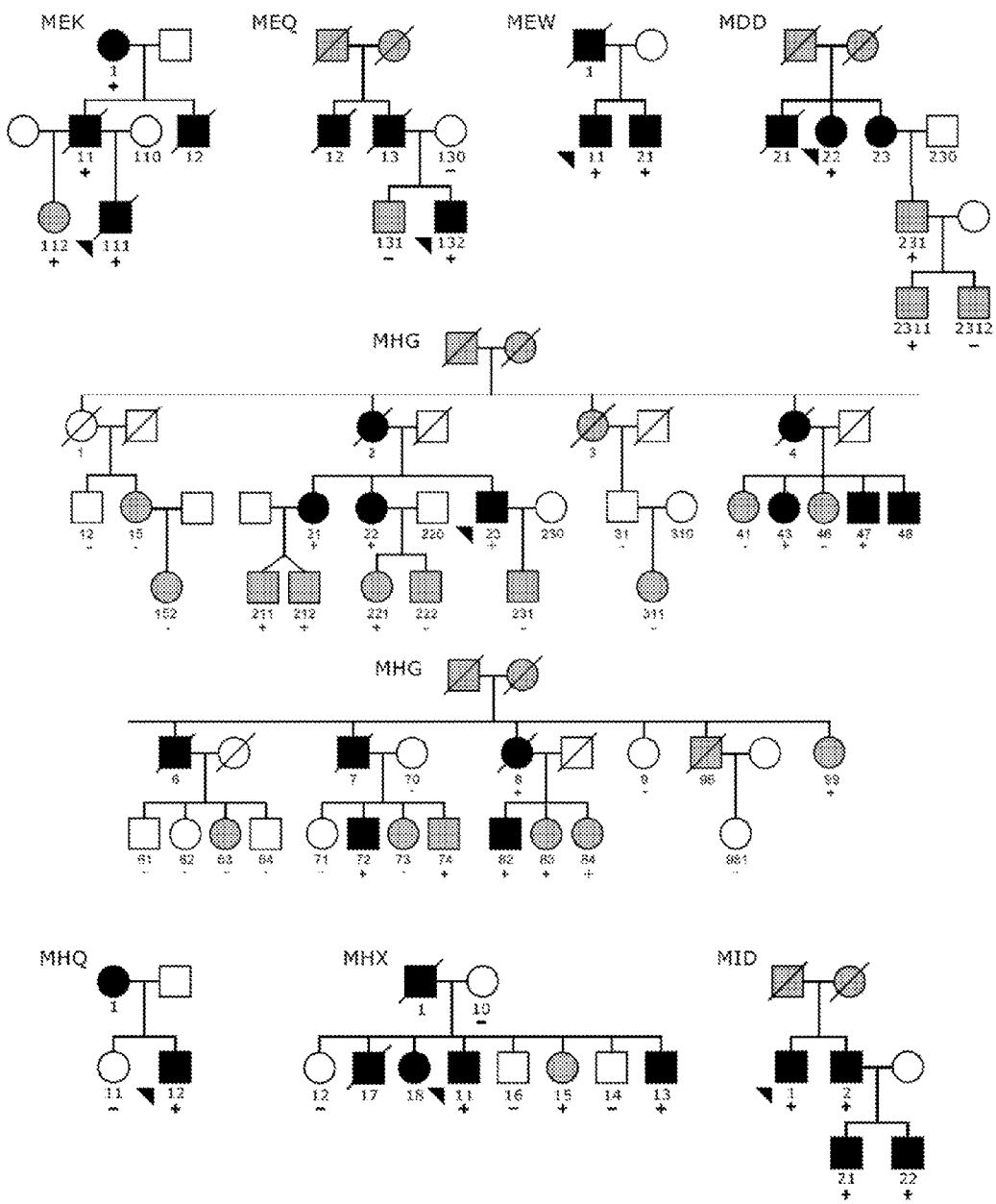
FIG. 5 depicts pedigrees of families with TTN truncation mutations. Probands (arrow) and family members are from group A or group C of the DCM cohort. Clinical status defined by cardiac evaluations and/or medical records is indicated: black, DCM; white, unaffected; grey, status uncertain due to age≤40 years, and/or confounding cardiac diagnoses; slash, deceased. Genotypes (+, TTN mutation present; −, mutation absent) are indicated.
Figure 5:
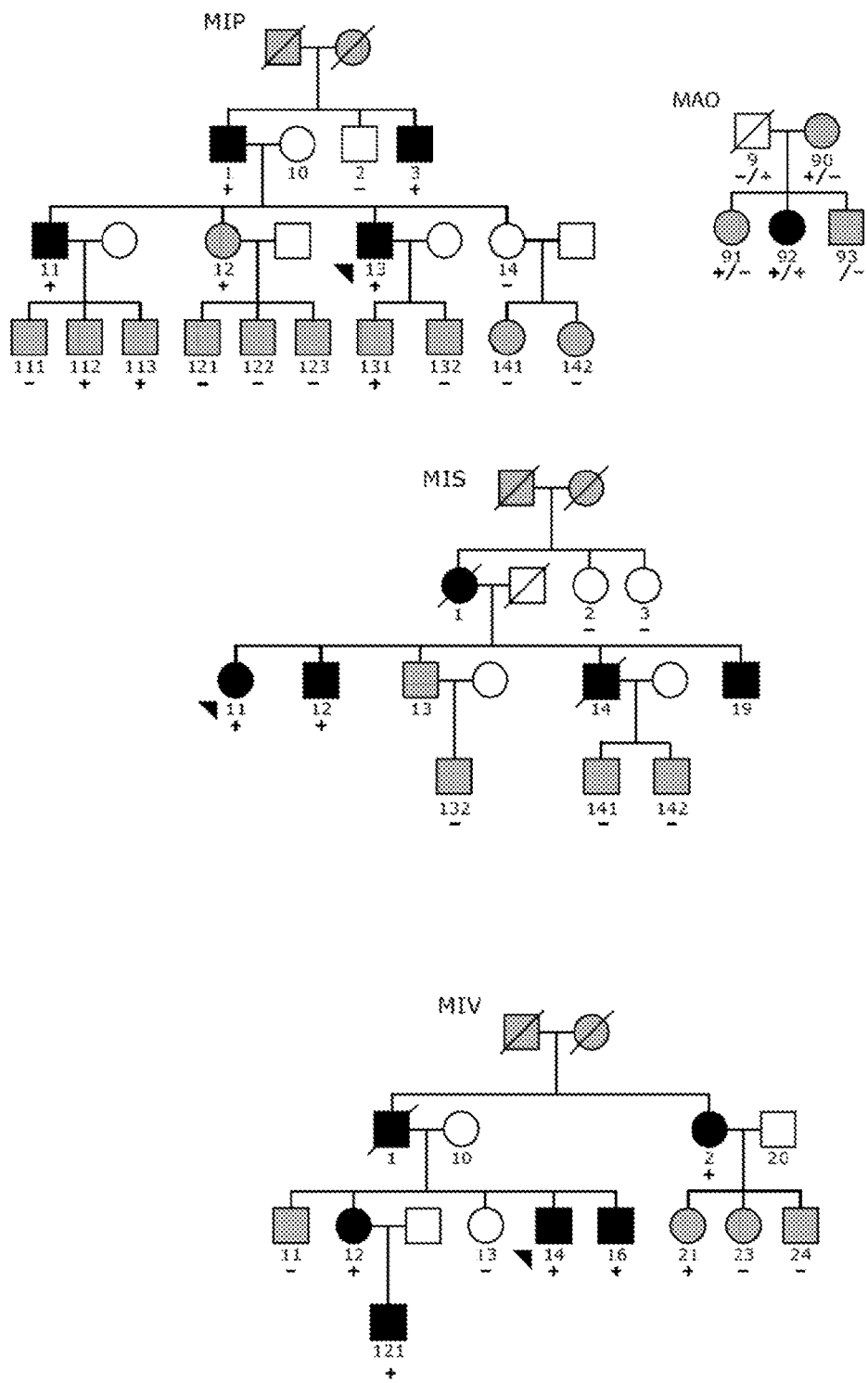
Figure 5:
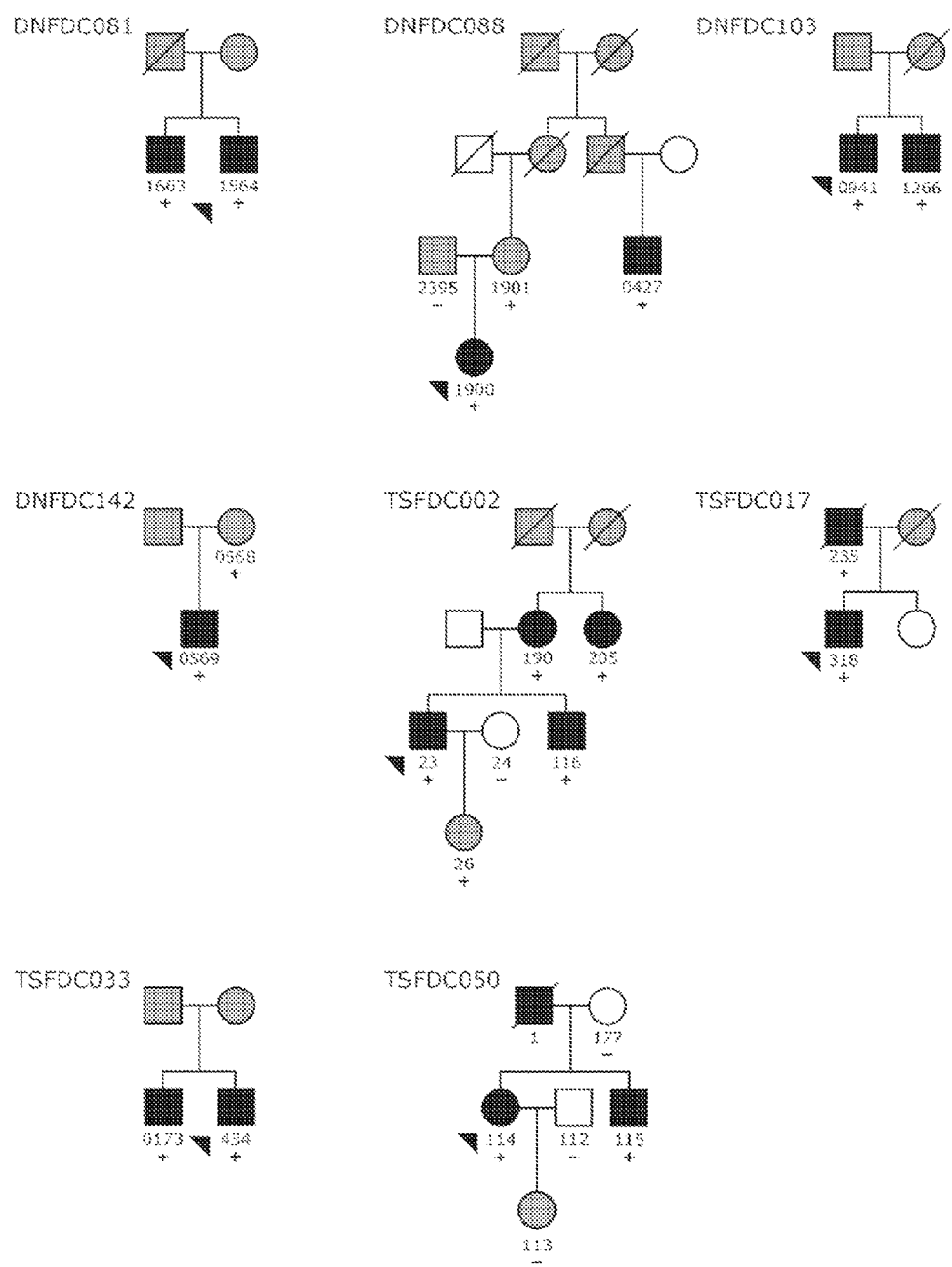
Figures 6A, 6B, 6C, 6D:
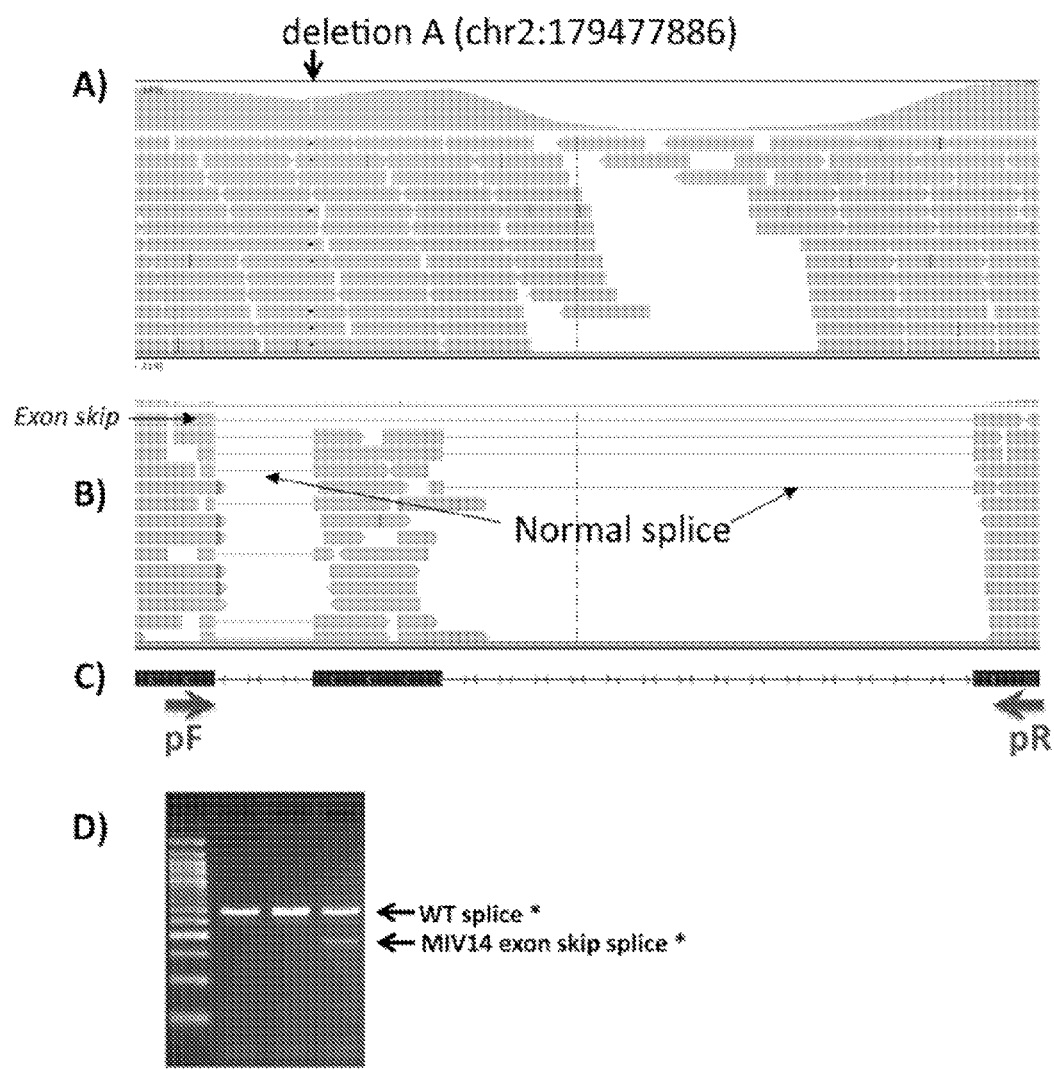
FIGS. 6A-6D demonstrate that TTN mutation (c.44725+2delT) disrupts normal splicing. The consequences of a single A/T basepair deletion at chr2:179477886 (identified in genomic DNA from subject MIV-14) on splicing was assessed by sequencing RNA from the subject's explanted left ventricular tissue.

Two-point logarithm of the odds (LOD) scores were calculated in 19 DCM families (FIG. 5; Table 15) using FASTLINK™ software, computed at theta=0, phenocopy rate=0.005[33], and indicated disease penetrances[34]. An indeterminate status was assigned to family members≤40 years old without clinical criteria for DCM[27] and to family members with confounding cardiac diagnoses.

Subject Cohorts:

Study subjects with dilated cardiomyopathy (DCM) were recruited form 3 independent groups. Group A was recruited from among DCM patients clinically evaluated at the Brigham and Women's Cardiovascular Genetics Center and subjects referred directly for research genetic evaluation. Group B was recruited from UK patients undergoing evaluation for cardiac transplantation with sufficient DNA samples for genetic analyses. Group C was recruited from subjects prospectively recruited in Colorado or Italy into a Familial Dilated Cardiomyopathy Registry. Ischemic heart disease was assessed in subjects from Groups A and C non-invasive studies and/or cardiac catheterization. All subjects in cohort DCM-B had coronary arteriography. Subjects who were found to have significant coronary artery disease or who were diagnosed with DCM in infancy were excluded from study. Groups A and C were enriched for subjects with a known family history of DCM. Concurrent genetic studies of other previously identified DCM genes[1-10] in subjects recruited from the Brigham and Women's Cardiovascular Genetics Center, led to the identification of likely pathogenic mutations in 40 subjects. These 40 group A subjects did not undergo TTN sequencing or phenotypic analyses reported here. However, to avoid untended inflation of the frequency of TTN truncating mutations in DCM, the size of group A was increased by 40 subjects for comparisons of mutation frequencies.

The hypertrophic cardiomyopathy (HCM) cohort consisted of 136 subjects recruited from the Brigham and Women's Cardiovascular Center, and subjects referred directly for research genetic studies and 100 HCM subjects who underwent septal myectomy at the Mayo Clinic, Rochester, Minn.

DCM and HCM subjects were diagnosed according to standard guidelines[11, 12] without knowledge of genotype. Control samples (n=249) are from de-identified subjects, recruited from multiple sites, with no known history of idiopathic cardiomyopathy. There were no significant differences in the frequencies of TTN truncating variants amongst control samples from different sites.

All studies were performed in accordance with institutional guidelines and with the approval of the local ethics committees. Subjects in DCM groups A and C, all HCM, and all control subjects provided written informed consent. Within the proband cohorts, no subjects had a known familial relationship.

Segregation Analyses:

For linkage studies, unknown affection status was assigned to family members of age≤40 years who lacked criteria for DCM and/or had confounding clinical diagnoses. Logarithm of the odds scores were calculated using FASTLINK (available on the world wide web at http://www.ncbi.nlm.nih.gov/CBBresearch/Schaffer/fastlink.html)[13]

Kaplan-Meier curves (FIG. 2D) of freedom from cardiac transplant, left ventricular assist device implantation, and death in male and female mutation carriers remained significantly different when family was used as a covariate (P=1.4×10$^{-5}$).

DNA Sequencing:

Targets for filter-based hybridization capture were defined as TTN exons in the UCSC hg18 refGene table (NM_003319, NM_133437, NM_133378, NM_133432, NM_133379) or the hg18 known Gene table (uc002 umr.1, uc002 ums.1, uc010frc.1, uc010frd.1, uc010fre.1, uc002 umz.1, uc002unb.1)+/−10 bp and genomic intervals in the UCSC hg18 phastConsElements28wayPlacMammal and hg18 phastConsElements28way tables that were within 2 kb of TTN and had conservation scores>=350. Target regions within 180 bp of one another were merged and primers were designed using EXONPRIMER™ (available on the world wide web at http://ihg.gsf.de/ihg/ExonPrimer.html) or PRIMER3™ (available on the world wide web at http://frodo.wi.mit.edu/primer3) with a 28 bp target gap, an optimal annealing temperature of 62° C. and an optimal primer length of 22-24 bp. Filter traps were generated as previously described[14], except that PCR amplimers were not confirmed by dideoxy sequencing and all DNA cleanups were performed with AmpureXP beads (Agencourt). Target amplimers, including three autosomal, three X-chromosome, and three Y-chromosome amplimers that were added at one quarter the molarity of the TTN amplimers, as a control for capture and copy-number, are listed in Table 3.

Genomic DNA libraries were made from 0.5 to 3 μg of genomic DNA and captured largely as previously described[14]. However, most samples were sheared using a Covaris E200 in single tubes (10% duty cycle, 5 intensity, 200 cycles/burst for 13 m) with a sample volume of 120 μl and most subject libraries were barcoded with a 3 bp+'T' sequence (Table 4), pooled in groups of 10-21, and hybridized as a pool of 2 to 4 μg.

For dideoxy sequencing, ITN targets were defined as all coding exons in refseq transcripts NM_133378, NM_00319, and NM_133379.

Next-Generation DNA Sequence Analysis:

For next-generation sequence data, short-read sequences and quality scores were generated with Illumina GENOME ANALYZER PIPELINE SOFTWARE™ v1.0 to v.1.80, mapped with NOVALIGN™ V2.07.05 (available on the world wide web at http://www.novocraft.com/), using full Needleman-Wunsch alignment, to the hg19 human reference genome. Sequence read base quality scores were recalibrated using the genome analysis toolkit (GATK) v1.0.4418[15]. Sequence reads were realigned (using GATK) and duplicate masked with PICARD™ (available on the world wide web at http://picard.sourceforge.net/). Single-nucleotide variants (SNV) and small indels were detected using GATK UNIFIEDGENOTYPER™. Shorter single-end sequencing read lengths (32-46 bp) in 56 HCM subjects and 2 control subjects may have limited detection of insertions/deletions (especially those with sizes greater than 3 bp) in these subjects. Reported comparisons remain significant if these subjects or larger mutations are excluded (data not shown). The quality of identified nonsense, frameshift, and splicing variants was assessed using additional GATK tools and visual inspection using the INTEGRATIVE GENOMICS VIEWER™[16]. The quality of missense variants (excluding nonsense and frameshift variants) was assessed using automated GATK tools alone.

The effect of each variant on titin RNA and protein was predicted using transcript definitions from the UCSC hg19 refGene table, with slight adaptations (see below). To identify variants likely to affect splicing, for each variant within the splice-donor or splice-acceptor sites, the difference between the log 2(maximum-entropy) of the mutant allele and that of the wild-type allele was calculated using an existing maximum entropy model[17]. Twenty-seven variants were identified with a maximum-entropy difference less than −2. Twenty-three of these variants were seen either in a single subject or in subjects with the same diagnosis and were absent from the 1000 Genomes Project[18, 19] Phase I data (629 samples; 20100804 genotypes) (1KG). However, variant c.40160-10A>G was identified in subjects with different diagnoses and present in 1KG, variant c.3100G>A was present in a subject with DCM and one with HCM, and variants c.10114+5G>A and c.30811+5G>A were present in 1KG. Excluding these four variants left 23 variants likely to substantially affect splicing (Table 9).

In all subjects studied by next-generation sequencing, the copy-number of ITN amplimers was assessed by visual inspection of heat maps and quantile-quantile plots of normalized median read depths (data not shown). TTN copy number heat maps were constructed using the log base-2 copy-ratio of a subject's target amplimer. Copy-ratios were iteratively median-normalized by amplimer and subject. The median read depths of each amplimer in each subject were median-normalized by both amplimer and sample. Newly identified variants were confirmed by the presence of sequence reads spanning likely DNA breakpoints and by breakpoint PCR (Table 10 and FIG. 7).

Forty-five TTN variants identified by next-generation sequencing in subjects with DCM from groups A and B, including 15 frameshifts, 17 nonsense, 12 splice, and one duplication, were assessed by independent dideoxy genomic sequencing and/or RNA sequencing and/or by restriction enzyme digest analyses (FIGS. 6A-6D and data not shown). All were confirmed (100% validation).

TTN Transcript Definitions Used For Variant Analyses:

The TTN consensus transcript sequence (Q8WZ42.nt) used to describe most variants was constructed to correspond to the protein sequence UniProtKB Q8WZ42 version 88. This transcript was defined as the combination of the UCSC hg19 alignments of RefSeq transcripts NM_003319 (N2B) and NM_133378 (N2A). The protein product predicted by the genomic sequence differs from Q8WZ42 at positions 17036-17043, because of a likely insertion of 'C' at position 51,102 of the cDNA sequence encoding Q8WZ42, and at several scattered single amino acids encoded by polymorphic nucleotides. The few exons (identified by black carets in FIG. 1 and defined in Table 17), with the least evidence for cardiac expression (Illumina Human Body Map 2.0 Project and unpublished) were excluded from analyses. Variants falling outside of this transcript are described using transcript definitions that include the corresponding alternatively spliced exon (novex-3, NM_133379; novex-1, NM_133432; novex-2, NM_133437).

TTN Variants In dbSNP:

In dbSNP version 132, there are nine TTN nonsense SNPs (rs72646813, rs72646828, rs72646831, rs72646837, rs72646846, rs72648222, rs72648224, rs72648249, rs72648250) and two TTN frameshift variants (rs72647879, rs72648265) that were found by dideoxy sequencing of DCM subjects in group C (see the Methods, DNA Sequencing and Genotyping). For all other nonsense or frameshift TTN variants in dbSNP version 132, population frequencies are not provided and these have not been validated.

Previous studies have reported structural mutations within the M-band portion of titin in subjects with recessive, early-onset skeletal and cardiac myopathy or tibial muscular dystrophy (Table 16). Carmignac et al.,[22] showed that truncated titin peptides lacking part of the M-band were incorporated into the sarcomere. No TTN truncating mutations were identified herein within the M-band portion in subjects with DCM, implying that M-band TTN truncating mutations may not cause isolated DCM. As such, in addition to assessing the uniformity of TTN truncating mutations in DCM subjects across all of titin, the spatial uniformity of mutations was assessed when excluding the portion of titin distal to the previously reported carboxy-terminal titin truncations that do not appear to cause dominant DCM. With this exclusion the associations remained significant (data not shown).

Results

Subject Characteristics:

Idiopathic DCM was diagnosed in 312 subjects from three independent cohorts: DCM-A, DCM-B, and DCM-C (Tables 11-13). HCM was diagnosed in 231 subjects; 249 subjects without known cardiomyopathy served as controls. Summary characteristics of each cohort are presented in Table 5.

TTN Genetic Variation

DNA Sequencing:

Using genomic DNA isolated from DCM-A, DCM-B, HCM, and control subjects, next-generation sequencing of 145 kb of TTN, including all annotated exons and splice sites was performed. For each subject, >97% of targeted bases were observed≥20 times (data not shown). From genomic DNA isolated from DCM-C subjects, TTN sequences were determined by traditional dideoxy sequencing. After excluding TTN variants with frequencies≥0.01 in the 1000 Genomes Project (available on the world wide web at www.1000genomes.org/data) or present in subjects (N=792) from all cohorts, 951 rare missense were identified, nonsense, frameshift, splicing or copy number TTN variants that are predicted to change the titin amino acid sequence (Tables 6, 7). Each subject in DCM, HCM or control cohorts had approximately one rare missense variant (range by cohort is 0.91-1.45 per subject.)

As the ITN transcript novex-3 (FIG. 1) is thought to not interact with the sarcomere M-band and is expressed in the heart approximately 20-fold less than full-length titin isoforms (data not shown), variants that exclusively altered novex-3 transcripts were not studied here. Analyses were prioritized for nonsense, frameshift, splicing, and copy-number variants, which unlike missense variants, are all predicted to have a profound effect on the structure of titin N2A or N2BA polypeptides (FIG. 1). These are denoted as TTN truncating variants.

TTN Variants in HCM and Control Subjects:

Among HCM subjects, three TTN truncating variants were found: two frameshift variants and one splicing variant (Supplementary Tables 8, 9). In each of these three subjects, concurrent analyses revealed a pathogenic mutation in well-established HCM gene MYH7 or MYBPC3 (data not shown). No family members were available for segregation analyses. In control subjects, two frameshift and five splicing variants were identified (FIG. 1 and Tables 8, 9). The frequency of TTN truncating variants did not differ significantly between subjects with hypertrophic cardiomyopathy and controls (1% and 3%, respectively; P=0.34).

Nonsense and Frameshift Variants in DCM Subjects:

Forty four nonsense or frameshift variants were identified that alter full-length titin in DCM subjects (Tables 1 and 8). Among cohorts studied by next-generation sequencing, subjects in cohort DCM-A (N=21; 23%) and DCM-B (N=14; 20%) were enriched for these variants as compared to HCM subjects (N=2; 0.9%; $P=2\times10^{-12}$) or control subjects (N=2; 0.08%; $P=3\times10^{-13}$). Twelve DCM-C subjects (8%) studied by traditional dideoxy sequencing had such variants. Strong co-segregation (LOD=9.3) of nonsense and frameshift variants was observed with clinical status among 60 members of 16 DCM families (FIG. 5, Tables 14, 15), indicating odds of ~1 in $10^9$ that the segregation of these TTN variants occurred by chance. Interestingly, subject MAO-92 who presented with DCM at age 17, had one rare variant on each TTN allele, a previously described pathogenic missense mutation[9] and a nonsense variant inherited from her mother (FIG. 5). In all other families, there was co-inheritance of DCM and a single TTN frameshift or nonsense variant. The penetrance of TTN truncating mutations in available family members over the age of 40 (N=32) is >95%.

Splicing Variants in DCM Subjects:

Seventeen TTN variants were identified in DCM subjects that are predicted to alter RNA splicing, including 11 that altered absolutely conserved splice-site nucleotides (Tables 1 and 9). RNA sequencing of cardiac tissues from two subjects with splicing variants, MIV-14 (FIGS. 6A-6D) and MAM-12 (an adult offspring of a consanguineous marriage with a homozygous splicing variant; data not shown) confirmed aberrant TTN splicing. Among subjects studied by next-generation sequencing, significant enrichment for subjects with splicing variants in DCM-A (N=15; 16%) and DCM-B (N=3; 4%) was observed as compared to HCM (N=1; $P=7\times10^{-8}$) or to control (N=5; $P=9\times10^{-6}$) cohorts. Complete co-segregation of splicing variants and DCM (LOD=1.8 or 60 times more likely than a chance association) was found among 11 members of three families (FIG. 5, Table 15).

Figure 7:
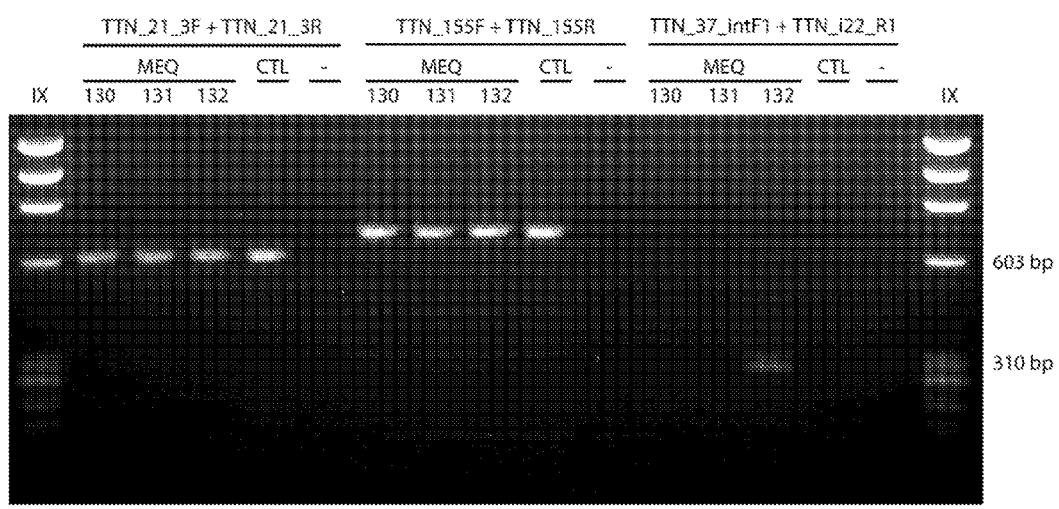
FIG. 7 demonstrates confirmation of a large ITN tandem-insertion in MEQ-132. Primer pairs TTN_21_3F and TTN_21_3R (amplimer TTN_21), TTN_155F and TTN_155R (amplimers TTN_155), and TTN_37+intF1 and TTN_i22_R1 (predicted break-point) were used for PCR amplification of genomic DNA from proband MEQ-132, unaffected relatives (MEQ-130, MEQ-131) and an unrelated control sample (CTL). The lane denoted by '−' contained no genomic DNA. The predicted size of the PCR product was 292 bp.

DCM Copy-number Variants:

Copy number was assessed across TTN in DCM-A and DCM-B subjects by comparing the distribution of sequence reads between individuals (data not shown). Traditional dideoxy sequencing of DCM-C subjects did not permit these analyses. A single copy-number variant (CNV) was identified in a DCM subject (MEQ-132). This tandem insertion of 28 kb (spanning introns 71 to 124) was predicted to incorporate a 13% internal duplication of a portion of titin and was confirmed in MEQ-132 and absent from two healthy relatives (FIG. 7). No TTN CNVs were observed among HCM or control subjects (N=480).

Consequences Of Ttn Truncating Variations:

Because TTN nonsense, frameshift, splicing and copy-number variants that are predicted to substantially alter titin structure, were significantly enriched among DCM subjects, compared to hypertrophic cardiomyopathy subjects ($P=3\times10^{-16}$) or controls ($P=9\times10^{-14}$), and were co-inherited with DCM in families, the data suggest that they cause DCM. Of note, six TTN mutations were each present in two subjects; analyses of one subject pair were consistent with a shared haplotype (data not shown).

To conservatively estimate the frequency of truncating TTN mutations in DCM, the total DCM-A population was increased by 40 additional subjects recruited concurrently with the subjects in cohort DCM-A whose TTN sequences were not analyzed because studies revealed a pathogenic mutation in another DCM gene. Accordingly, the frequencies of TTN truncating mutations in the DCM cohorts were 28% (DCM-A), 24% (DCM-B) and 9% (DCM-C). TTN mutation frequencies were not significantly different between subjects with and without a family history of DCM (Table 5; P=0.36).

Figures 4A, 4B:
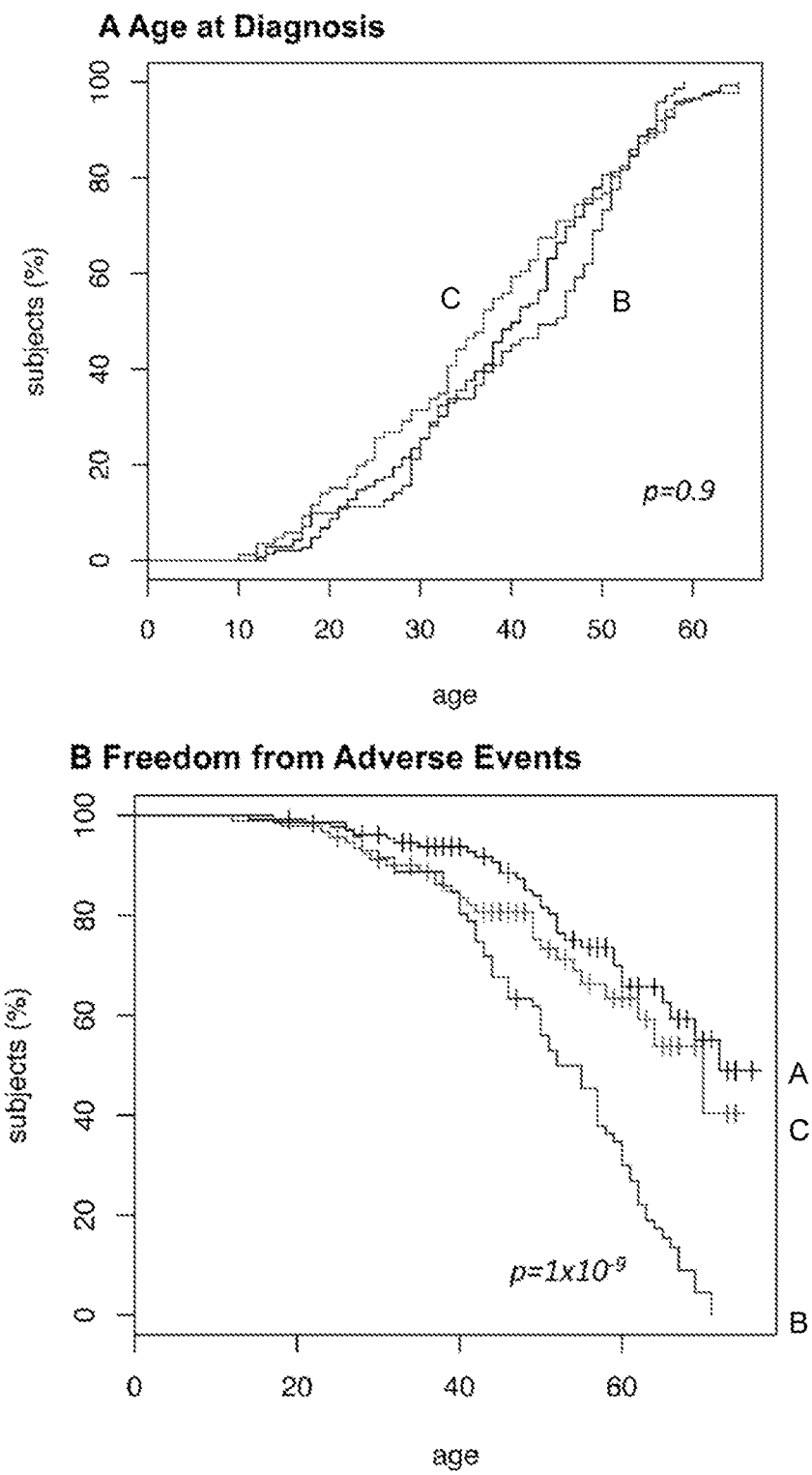
FIGS. 4A-4B depict Kaplan-Meier curves displaying (FIG. 4A) age of clinical diagnosis and (FIG. 4B) freedom cardiac transplantation, ventricular assist device and/or death among subjects with DCM from group A, group B, and group C.

Between the two different DNA-sequencing platforms used to analyze data for the subjects with dilated cardiomyopathy, more subjects in groups A and B than in group C were found to have TTN truncations (P<0.001). Clinical features among the dilated cardiomyopathy groups (ascertained during evaluation for cardiac transplantation) included more familial disease in group A than in group B (P<0.001) or group C(P=0.005) and more severe dilated cardiomyopathy among the subjects in group B, who had a significantly increased left ventricular end diastolic diameter as compared with group A ($P=1\times10^{-19}$) and group C($P=3\times10^{-6}$), as well as an increased left ventricular ejection fraction (P=0.03 and P=0.001, respectively) (Table 2, and FIGS. 4A-4B).

TTN truncating mutations found in DCM subjects were non-randomly distributed within titin (FIG. 1). DCM mutations were overrepresented in the A-band region as compared to either the remainder of N2BA (P=0.0004) or N2B (P=0.01) and were notably absent from the Z-disk and M-band regions of titin (P=0.006, N2BA; P=0.001, N2B). The distribution of the 10 variants found in HCM and control subjects (FIG. 1) was distinct (P=0.001), in that it was less enriched for the A-band region of titin (40% versus 84%; P=0.006) and included Z-band variants (20% versus 0%; P=0.01).

Figures 2A, 2B, 2C, 2D:
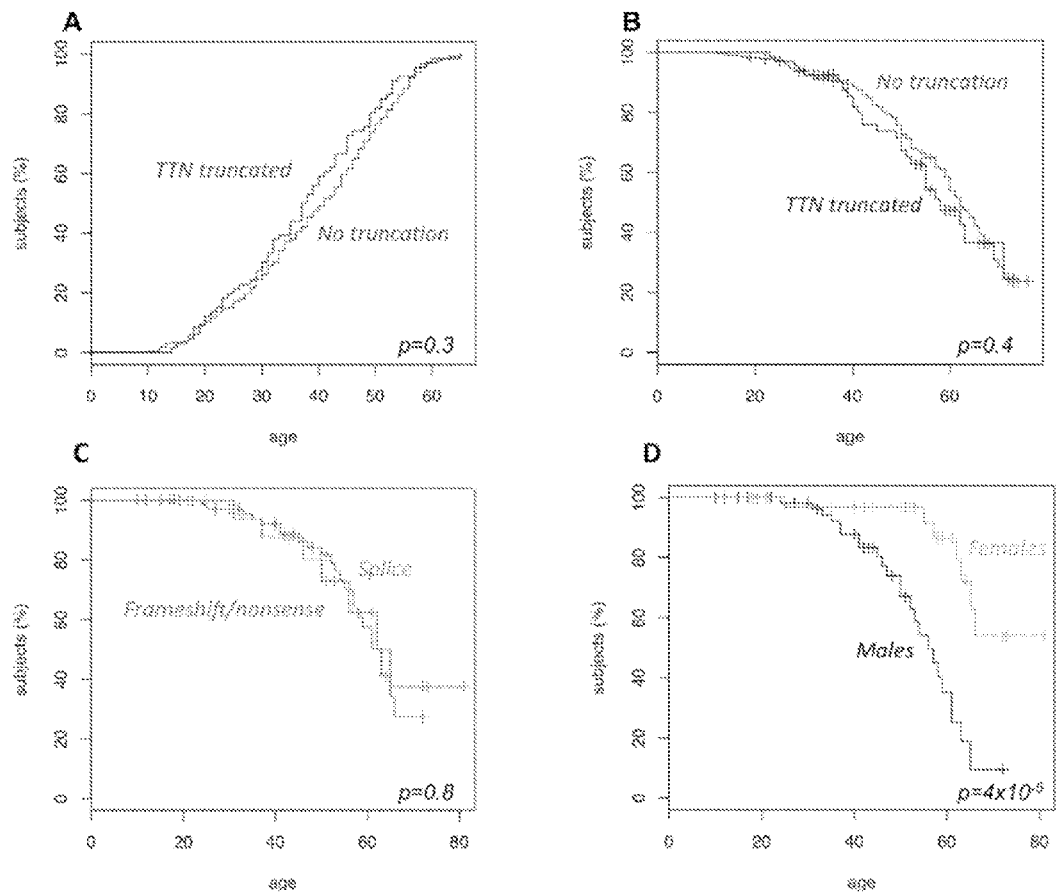
FIGS. 2A-2D depict the clinical onset and progression in DCM caused by TTN mutations. Kaplan-Meier curves comparing ages at diagnosis (FIG. 2A) and freedom from cardiac transplant, left ventricular assist device implantation, and death (FIG. 2B) of subjects in DCM-A, B, C cohorts with (N=67) and without (N=228) TTN truncating mutations. Kaplan-Meier curves comparing freedom from cardiac transplant, left ventricular assist device implantation, and death among 94 TTN truncation mutation carriers from 19 families (FIG. 5) classified according to mutation type (FIG. 2C) and gender (FIG. 2D).

Clinical Characteristics:

There were no significant differences (P>0.1) in ages at diagnosis, left ventricular end-diastolic dimensions, ejection fraction, or freedom from cardiac transplant, left ventricular assist device implantation, or death between subjects with and without TTN truncating mutations (Table 2, FIGS. 2A, 2B).

Figures 3A, 3B:
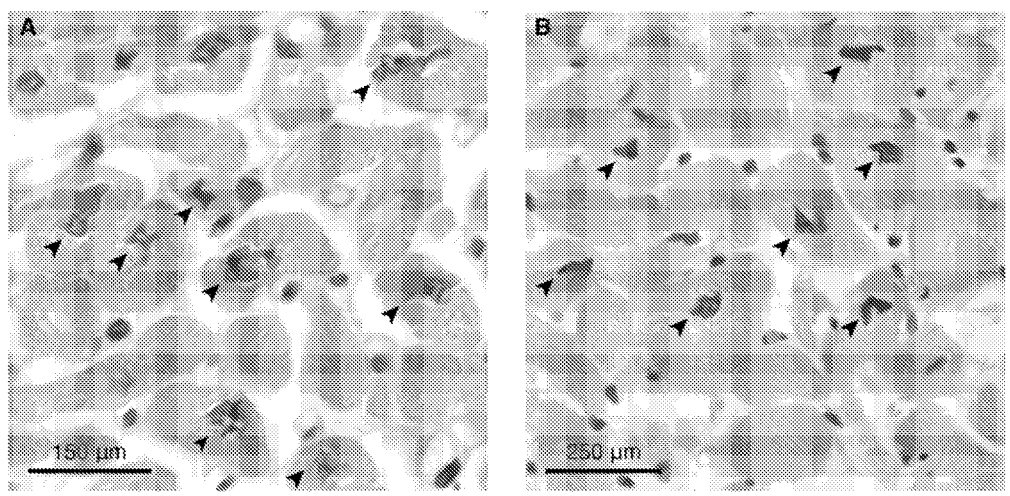
FIGS. 3A-3B depict myocardial histopathology of subjects with TTN structural mutations. Light microscopy of hematoxylin and eosin stained specimens from the cardiac interventricular septum of subject MEK-111 (FIG. 3A) or MGW-11 (FIG. 3B). Myocyte nuclei with abnormal morphology are indicated (arrowheads).
Figure 8:
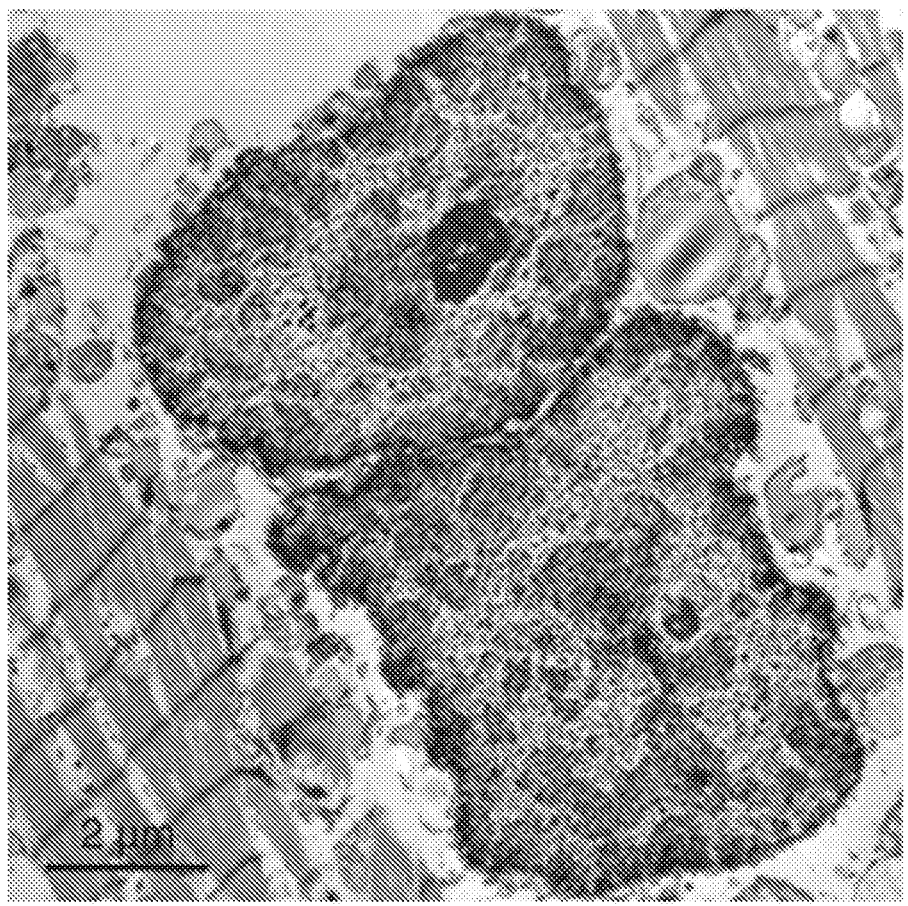
FIG. 8 depicts a transmission electron micrograph of a cardiac left ventricular free wall specimen, derived at autopsy, from DCM-A subject MGW-11 who carries a TTN nonsense mutation (p.Arg26949X). Sarcomere structure is normal. The myocyte nucleus is highly lobulated.

Subjects with TTN truncating mutations had DCM that usually was unaccompanied by conduction system or skeletal muscle disease (Tables 11, 12, 13), although an overt skeletal myopathy occurred in subject MAM-12 with a homozygous TTN splicing mutation. Cardiac histopathology from subjects with TTN truncating mutations was typical of idiopathic DCM. Of note, some sections revealed foci of myocytes with bizarre, stellate nuclear morphology, best appreciated in cross-section (FIGS. 3A-3B). Electron microscopy of one specimen obtained post-mortem, showed intact sarcomeric structures (FIG. 8).

Freedom from cardiac transplant, left ventricular assist device implantation, or death in subjects and family members with TTN mutations was influenced by gender (FIGS. 2C-2D). The mean age for these adverse events in mutation carriers within families (N=94; 19 families) was 68±5 years for women (N=33) and 56±3 years for men (N=61; FIGS. 2A-2D).

Discussion

TTN truncating variants were identified in 67 DCM subjects, three HCM subjects and seven control subjects (Tables 1, 2, 5, 6, 7, 8, and 9). TTN variants included nonsense and frameshifts that are predicted to cause protein truncation; variants of splice donor or acceptor sites that are predicted to cause exon skipping and/or to include intronic sequence or delete exonic sequence; and a large tandem insertion. Without out wishing to be bound by theory, it is possible that these mutant alleles produce shortened titin with abnormal properties that cause DCM.

There was a low frequency of TTN truncating variants in HCM subjects was not different than the frequency in controls. In addition, each HCM subject with a TTN variant also had a pathogenic mutation in an established HCM gene, suggesting that TTN truncations rarely, if ever, cause HCM.

The frequency of DCM subjects with TTN truncating mutations was significantly higher than that of HCM subjects ($P=3\times10^{-16}$) or control subjects ($P=9\times10^{-14}$). Amongst the 3 groups of subjects with dilated cardiomyopathy, the frequency of TTN truncating mutations in group A and group B, was comparable ($P=0.7$) and significantly different from group C ($P=3\times10^{-5}$) that was studied by a different DNA sequencing platform. Although distinguishing clinical features of dilated cardiomyopathy were identified in subjects in each group, the lower frequency of mutations identified in DCM-C subjects raises the possibility that the next-generation sequencing strategy provided better mutation detection than dideoxy sequencing.

TTN truncating mutations and DCM were co-inherited in families (combined LOD score=11.1; FIG. 5, Table 15). Segregation analyses of frameshift or nonsense mutations in 17 families (LOD=9.3) and splice site mutations in three families (LOD=1.8) confirmed the co-inheritance of each type of truncating mutation. Family studies also demonstrated that the penetrance of TTN truncating mutations was >95% for the studied subjects over the age of 40 years (FIG. 5, Table 14).

DCM subjects with and without TTN truncating mutations had similar clinical manifestations and comparable morbidity and mortality, but men with TTN mutations had adverse events at significantly earlier ages than women ($P=4\times10^{-5}$). Gender is reported to influence outcomes in heart failure caused by various etiologies[35]. However, that gender would substantially influence an autosomal monogenetic cause of heart failure is unexpected and warrants further study.

Mutations that significantly disrupt the structure of full-length titin can cause DCM by several mechanisms. RNA and protein surveillance pathways likely degrade some truncated titin peptides[36]. Decreased titin levels could limit sarcomere formation and might produce cardiac dysfunction and remodeling. Yet this is not the case for previously reported TTN mutations that delete only the M-band portion of titin[14] (FIG. 1); immunohistochemical studies showed some of these truncated titin proteins integrate into the sarcomere and cause recessive, early-onset skeletal and cardiac myopathy and not dominant DCM. In addition, if more proximal TTN truncating mutations caused DCM via haploinsufficiency, the distribution of such mutations would be rather uniform across the susceptible portion of titin. In contrast, a biased mutation distribution was observed in DCM subjects that was distinct from that observed in non-DCM subjects (FIG. 1 and above herein). This unequal mutation distribution may indicate that truncated titin proteins found in DCM subjects, like previously studied carboxy-terminal titin truncations, integrate into the sarcomere and cause DCM by a dominant-negative mechanism.

If truncated titin proteins in DCM subjects incorporated into the sarcomere, they would likely be anchored at the Z-line and interact with the full complement of Z-disk factors (FIG. 1). However, these truncated titin proteins would not include the M-band residues that anchor titin to the middle of the sarcomere via myomesin, encode a kinase domain, and interact with many proteins[37]. The M-band portion of titin is implicated in sensing and modulating sarcomeric force[12, 38-40]. Without wishing to be bound by theory, it is suggested that loss of these interactions could lead to DCM by disturbing normal regulation of sarcomeric force.

The data presented herein indicate that TTN truncating mutations are the most common known genetic cause of DCM. Ongoing analyses of other classes of TTN variation (e.g., missense variants) may further expand the importance of TTN in DCM pathogenesis. Incorporation of next-generation sequence analyses of TTN into clinical genetic screens should substantially increase the detection of DCM mutations by approximately 50%, enabling earlier diagnosis and interventions to prevent disease progression. Further study of the functional consequences of TTN truncating mutations on myocardial physiology and myocyte signaling is warranted.

REFERENCES

1. Morita H, Rehm H L, Menesses A, et al. Shared genetic causes of cardiac hypertrophy in children and adults. N Engl J Med 2008; 358(18):1899-908.
2. Olivotto I, Girolami F, Ackerman M J, et al. Myofilament protein gene mutation screening and outcome of patients with hypertrophic cardiomyopathy. Mayo Clin Proc 2008; 83(6):630-8.
3. Ahmad F, Seidman J G, Seidman C E. The genetic basis for cardiac remodeling. Annual review of genomics and human genetics 2005; 6:185-216.
4. Dellefave L, Mcnally E M. The genetics of dilated cardiomyopathy. Current Opinion in Cardiology 2010; 25(3):198-204.
5. Michels W, Moll P P, Miller F A, et al. The frequency of familial dilated cardiomyopathy in a series of patients with idiopathic dilated cardiomyopathy. N Engl J Med 1992; 326(2):77-82.
6. Baig M, Goldman J, Caforio A, Coonar A, Keeling P, McKenna W. Familial dilated cardiomyopathy: cardiac abnormalities are common in asymptomatic relatives and may represent early disease. Journal of the American College of Cardiology 1998; 31(1):195.
7. Mestroni L, Rocco C, Gregori D, et al. Familial dilated cardiomyopathy* 1:: Evidence for genetic and phenotypic heterogeneity. Journal of the American College of Cardiology 1999; 34(1):181-90.
8. Zimmerman R S, Cox S, Lakdawala N K, et al. A novel custom resequencing array for dilated cardiomyopathy. Genet Med 2010; 12(5):268-78.
9. Siu B L, Niimura H, Osborne J A, et al. Familial dilated cardiomyopathy locus maps to chromosome 2q31. Circulation 1999; 99(8):1022-6.
10. Gerull B, Atherton J, Geupel A, et al. Identification of a novel frameshift mutation in the giant muscle filament titin in a large Australian family with dilated cardiomyopathy. J Mol Med 2006; 84(6):478-83.
11. Gerull B, Gramlich M, Atherton J, et al. Mutations of TTN, encoding the giant muscle filament titin, cause familial dilated cardiomyopathy. Nat Genet 2002; 30(2):201-4.
12. Lange S, Xiang F, Yakovenko A, et al. The kinase domain of titin controls muscle gene expression and protein turnover. Science 2005; 308(5728):1599-603.
13. Hackman P, Vihola A, Haravuori H, et al. Tibial muscular dystrophy is a titinopathy caused by mutations in TTN, the gene encoding the giant skeletal-muscle protein titin. Am J Hum Genet 2002; 71(3):492-500.
14. Carmignac V, Salih M A M, Quijano-Roy S, et al. C-terminal titin deletions cause a novel early-onset myopathy with fatal cardiomyopathy. Ann Neurol 2007; 61(4):340-51.

15. Hackman P, Marchand S, Sarparanta J, et al. Truncating mutations in C-terminal titin may cause more severe tibial muscular dystrophy (TMD). Neuromuscular Disorders 2008; 18(12):922-8.
16. Trinick J, Knight P, Whiting A. Purification and properties of native titin. J Mol Biol 1984; 180(2):331-56.
17. Liversage A D, Holmes D, Knight P J, Tskhovrebova L, Trinick J. Titin and the sarcomere symmetry paradox. J Mol Biol 2001; 305(3):401-9.
18. van der Ven P F, Bartsch J W, Gautel M, Jockusch H, Furst D O. A functional knock-out of titin results in defective myofibril assembly. J Cell Sci 2000; 113 (Pt 8):1405-14.
19. Musa H, Meek S, Gautel M, Peddie D, Smith A J H, Peckham M. Targeted homozygous deletion of M-band titin in cardiomyocytes prevents sarcomere formation. J Cell Sci 2006; 119(Pt 20):432231.
20. Granzier H L, Irving T C. Passive tension in cardiac muscle: contribution of collagen, titin, microtubules, and intermediate filaments. Biophysical Journal 1995; 68(3): 1027-44.
21. Horowits R, Kempner E S, Bisher M E, Podolsky R J. A physiological role for titin and nebulin in skeletal muscle. Nature 1986; 323(6084):160-4.
22. Muhle-Goll C, Habeck M, Cazorla O, Nilges M, Labeit S, Granzier H. Structural and functional studies of titin's fn3 modules reveal conserved surface patterns and binding to myosin S1—a possible role in the Frank-Starling mechanism of the heart. J Mol Biol 2001; 313(2):431-47.
23. Cazorla O, Wu Y, Irving T C, Granzier H. Titin-based modulation of calcium sensitivity of active tension in mouse skinned cardiac myocytes. Circulation Research 2001; 88(10):1028-35.
24. Guo W, Bharmal S J, Esbona K, greater M L. Titin diversity—alternative splicing gone wild. J Biomed Biotechnol 2010; 2010:753675.
25. Bang M L, Centner T, Formoff F, et al. The complete gene sequence of titin, expression of an unusual approximately 700-kDa titin isoform, and its interaction with obscurin identify a novel Z-line to I-band linking system. Circulation Research 2001; 89(11):1065-72.
26. Herman D S, Hovingh G K, Iartchouk O, et al. Filter-based hybridization capture of subgenomes enables resequencing and copy-number detection. Nat Methods 2009: 27.
27. Mestroni L, Maisch B, McKenna W J, et al. Guidelines for the study of familial dilated cardiomyopathies. Collaborative Research Group of the European Human and Capital Mobility Project on Familial Dilated Cardiomyopathy. Eur Heart J 1999; 20(2):93-102.
28. Maron B J, McKenna W J, Danielson G K, et al. American College of Cardiology/European Society of Cardiology clinical expert consensus document on hypertrophic cardiomyopathy. A report of the American College of Cardiology Foundation Task Force on Clinical Expert Consensus Documents and the European Society of Cardiology Committee for Practice Guidelines. Journal of the American College of Cardiology 2003; 42(9):1687-713.
29. Bentley D R, Balasubramanian S, Swerdlow H P, et al. Accurate whole human genome sequencing using reversible terminator chemistry. Nature 2008; 456(7218):53-9.
30. Mckenna A, Hanna M, Banks E, et al. The Genome Analysis Toolkit: A MapReduce framework for analyzing next-generation DNA sequencing data. Genome Research 2010; 20(9):1297-303.
31. Team R D C. R: A Language and Environment for Statistical Computing. In: R Foundation for Statistical Computing; 2010.
32. Gramlich M, Michely B, Krohne C, et al. Stress-induced dilated cardiomyopathy in a knock-in mouse model mimicking human titin-based disease. Journal of Molecular and Cellular Cardiology 2009; 47(3):352-8.
33. Kontrogianni-Konstantopoulos A, Ackermann M A, Bowman A L, Yap S V, Bloch R J. Muscle Giants: Molecular Scaffolds in Sarcomerogenesis. Physiological Reviews 2009; 89(4):1217-67.
34. Peng J, Raddatz K, Molkentin J D, et al. Cardiac hypertrophy and reduced contractility in hearts deficient in the titin kinase region. Circulation 2007; 115(6):743-51.
35. Willis M S, Ike C, Li L, Wang D-Z, Glass D J, Patterson C. Muscle ring finger 1, but not muscle ring finger 2, regulates cardiac hypertrophy in vivo. Circulation Research 2007; 100(4):456-9.
36. Grater F, Shen J, Jiang H, Gautel M, Grubmiiller H. Mechanically induced titin kinase activation studied by force-probe molecular dynamics simulations. Biophysical Journal 2005; 88(2):790-804.
37. Noda S. Histopathology of endomyocardial biopsies from patients with idiopathic cardiomyopathy; quantitative evaluation based on multivariate statistical analysis. Jpn Circ J 1980; 44(2):95-116.
38. Ferrans V J, Jones M, Maron B J, Roberts W C. The nuclear membranes in hypertrophied human cardiac muscle cells. Am J Pathol 1975; 78(3):427-60.
39. Nikolova V, Leimena C, McMahon A C, et al. Defects in nuclear structure and function promote dilated cardiomyopathy in lamin A/C-deficient mice. J Clin Invest 2004; 113(3):357-69.
40. Granzier H, Labeit S. The Giant Protein Titin A Major Player in Myocardial Mechanics, Signaling, and Disease. Circ Res 2004.
41. Lakdawala N K, Dellefave L, Redwood C S, et al. Familial dilated cardiomyopathy caused by an alpha-tropomyosin mutation: the distinctive natural history of sarcomeric dilated cardiomyopathy. Journal of the American College of Cardiology 2010; 55(4):320-9.
42. Schonberger J, Wang L, Shin J T, et al. Mutation in the transcriptional coactivator EYA4 causes dilated cardiomyopathy and sensorineural hearing loss. Nat Genet 2005; 37(4):418-22.
43. Schmitt J P, Kamisago M, Asahi M, et al. Dilated cardiomyopathy and heart failure caused by a mutation in phospholamban. Science 2003; 299(5611):1410-3.
44. Gerull B, Gramlich M, Atherton J, et al. Mutations of TTN, encoding the giant muscle filament titin, cause familial dilated cardiomyopathy. Nat Genet 2002; 30(2): 201-4.
45. Kamisago M, Sharma S D, DePalma S R, et al. Mutations in sarcomere protein genes as a cause of dilated cardiomyopathy. N Engl J Med 2000; 343(23):1688-96.
46. Fatkin D, MacRae C, Sasaki T, et al. Missense mutations in the rod domain of the lamin A/C gene as causes of dilated cardiomyopathy and conduction-system disease. N Engl J Med 1999; 341(23):1715-24.
47. Taylor M R G, Slavov D, Ku L, et al. Prevalence of desmin mutations in dilated cardiomyopathy. Circulation 2007; 115(10):1244-51.
48. Taylor M R G, Slavov D, Gajewski A, et al. Thymopoietin (lamina-associated polypeptide 2) gene mutation associated with dilated cardiomyopathy. Hum Mutat 2005; 26(6):566-74.
49. Carniel E, Taylor M R G, Sinagra G, et al. Alpha-myosin heavy chain: a sarcomeric gene associated with dilated and hypertrophic phenotypes of cardiomyopathy. Circulation 2005; 112(1):54-9.
50. Taylor M R G, Fain P R, Sinagra G, et al. Natural history of dilated cardiomyopathy due to lamin A/C gene mutations. JAC 2003; 41(5):771-80.

51. Lathrop G, Lalouel J. Easy calculations of lod scores and genetic risks on small computers. Am J Hum Genet 1984; 36(2):460-5.
52. Gramlich M, Michely B, Krohne C, et al. Stress-induced dilated cardiomyopathy in a knock-in mouse model mimicking human titin-based disease. Journal of Molecular and Cellular Cardiology 2009; 47(3):352-8.
53. Fujita P, Rhead B, Zweig A, et al. The UCSC Genome Browser database: update 2011. Nucleic Acids Res 2011; 39(Database issue):D876-82.
54. Herman D S, Hovingh G K, Iartchouk O, et al. Filter-based hybridization capture of subgenomes enables resequencing and copy-number detection. Nat Methods 2009: 27.
55. Mckenna A, Hanna M, Banks E, et al. The Genome Analysis Toolkit: A MapReduce framework for analyzing next-generation DNA sequencing data. Genome Research 2010; 20(9):1297-303.
56. Robinson J T, Thorvaldsdottir H, Winckler W, et al. Integrative genomics viewer. Nature Biotechnology 2011; 29(1):24-6.
57. Yeo G, Burge C B. Maximum entropy modeling of short sequence motifs with applications to RNA splicing signals. J Comput Biol 2004; 11(2-3):377-94.
58. Consortium TGP, Author C, Committee S, et al. A map of human genome variation from population-scale sequencing. Nature 2010; 467(7319):1061-73.
59. Carmignac V, Salih M A M, Quijano-Roy S, et al. C-terminal titin deletions cause a novel early-onset myopathy with fatal cardiomyopathy. Ann Neurol 2007; 61(4):34051.
60. Hackman P, Marchand S, Sarparanta J, et al. Truncating mutations in C-terminal titin may cause more severe tibial muscular dystrophy (TMD). Neuromuscular Disorders 2008; 18(12):922-8.
61. Zimmerman R S, Cox S, Lakdawala N K, et al. A novel custom resequencing array for dilated cardiomyopathy. Genet Med 2010; 12(5):268-78.

TABLE 1

DCM, HCM and Control Subjects with TTN Truncating Variants*

| Mutation class | DCM (N = 312) | HCM (N = 231) | Control (N = 249) | p-value† | p-value^ |
|---|---|---|---|---|---|
| Nonsense | 28^ | 0 | 0 | $1 \times 10^{-10}$ | $5 \times 10^{-11}$ |
| Frameshift | 19^ | 2 | 2 | 0.0004 | $1 \times 10^{-5}$ |
| Splicing | 19^ | 1 | 5 | 0.001 | $4 \times 10^{-6}$ |
| Copy-number | 1 | 0 | 0 | NA | NA |
| All truncating | 67 | 3 | 7 | $<2 \times 10^{-16}$ | $<2 \times 10^{-16}$ |

Comparison of the fraction of DCM, HCM, and control subjects with TTN truncation mutations. ^ Three nonsense and three splicing mutations each occurred in two subjects. One DCM subject carried two different splicing mutations. P-values are calculated excluding the one copy-number mutation and including all subjects (†) or including only subjects studied by next-generation sequencing (^) plus 40 DCM subjects who were excluded from TTN sequencing for a total of 352 DCM subjects (detailed in text, see CONSEQUENCES OF TTN TRUNCATING VARIATIONS).

TABLE 2

Characteristics of DCM cohorts

| | DCM-A TTN truncating mutation | | DCM-B TTN truncating mutation | | DCM-C TTN truncating mutation | |
|---|---|---|---|---|---|---|
| | Yes N = 37 | No N = 55 | Yes N = 17 | No N = 54 | Yes N = 13 | No N = 136 |
| Female, no. (%) | 11 (30) | 17 (31) | 2 (12) | 14 (26) | 4 (31) | 56 (41) |
| Familial DCM (%) | 92% | 79% | 21% | 24% | 85% | 66% |
| Age (yrs) | 45.9 ± 13.6 | 46.7 ± 14.3 | 48.4 ± 11.0 | 51.7 ± 12.8 | 49.2 ± 12.8 | 49.7 ± 14.0 |
| Age at diagnosis (yrs) | 37.1 ± 13.2 | 37.3 ± 14.6 | 38.5 ± 9.8 | 41.3 ± 13.4 | 37.6 ± 14.7 | 39.6 ± 12.3 |
| LVEF (%) | 26.4 ± 10.8 | 30.7 ± 11.6 | 24.6 ± 11.0 | 24.8 ± 11.7 | 29.3 ± 8.5 | 31.4 ± 11.8 |
| FS (%) | 19.6 ± 9.90 | 19.6 ± 10.2 | NA | NA | 13.5 ± 3.4 | 16.6 ± 6.9 |
| LVEDD (mm) | 63.7 ± 10.9 | 61.4 ± 9.7 | 70.8 ± 8.1 | 74.2 ± 10.2 | 65.5 ± 9.2 | 65.6 ± 10.4 |
| LVEDD/BSA (mm/cm²) | 33.0 ± 5.1 | NA | 37.6 ± 6.0 | NA | 34.0 ± 7.1 | NA |
| NYHA III-IV (%) | 62% | 41% | 94% | 91% | 46% | 43% |
| ICD, no. (%) | 22 (59) | 30 (55) | 1 (6) | 2 (4) | 3 (100) | NA |
| Tx/VAD/Dead no. (%) | 14 (38) | 17 (31) | 17 (100) | 47 (87) | 1 (8) | 31(23) |

*Data are provided as means ± SD, standard deviation.
No., numbers of subjects,
NA not available.

Measurements are from echocardiograms, including LVEF, left ventricular ejection fraction; FS, fractional shortening; LVEDD, left ventricular end-diastolic diameter and LVEDD divided by BSA, body surface area.

NYHA III-IV: Percentage of subjects with New York Heart Association functional class III or IV.

ICD: Number of subjects who with an implantable cardioverter defibrillator

Tx, VAD, death: Numbers of subjects with a cardiac transplant (Tx), ventricular assist device (VAD) or had a cardiac death.

TABLE 3

TTN and Control amplimer PCR primers*

| Amplimer | Forward primer | SEQ ID NO | Reverse primer | SEQ ID NO | Chr | Start | End |
|---|---|---|---|---|---|---|---|
| TTN_1#1 | TTTGAACTTGAGTTGCCTTATCTATC | 004 | GATGTTTGCATTTACCCTCCTG | 0342 | chr2 | 179390615 | 179391238 |
| TTN_3#7 | ACCTCAGGCGTTCCACTTGTAG | 005 | ACCAGAATTTACCCTGCCTCTC | 0343 | chr2 | 179397970 | 179398571 |
| TTN_7#4 | TGTATTTTCCAGCATCGTACCG | 006 | GAGCAATAATGCCTTTGTGAGTC | 0344 | chr2 | 179408621 | 179409331 |
| TTN_10#4 | GGTTCACCAACTCCATTTTCTATTG | 007 | CTTGGCTGGAGTAAGCCTGTC | 0345 | chr2 | 179417865 | 179418475 |
| TTN_13#5 | CAAGCATGGTAGATTTTGTGGC | 008 | GAGTGCCAGTAATTGCAAGGG | 0346 | chr2 | 179426342 | 179427007 |
| TTN_13#16 | GGAAATGGCTGTGGCAAATG | 009 | CCAAAGATCTGGTAATTGAGCC | 0347 | chr2 | 179432850 | 179433487 |
| TTN_13#27 | GCCAGCTAATTGTCATTGAATCC | 010 | GTCAAGGAGCAGACAATGCTTC | 0348 | chr2 | 179439317 | 179439989 |
| TTN_18#1 | TCCGAGATTTAAATGTGCCTCC | 011 | TGGAGAAGTGTGATGTAAGCCG | 0349 | chr2 | 179448936 | 179449578 |
| TTN_1#2 | TGGCCGTTACACTTTGCTCTG | 012 | GATCCATTTAAGAGGGCCTGTG | 0350 | chr2 | 179391128 | 179391749 |
| TTN_3#8 | TTACTCCAAACCGGACATTTTC | 013 | AGCACCCATGGTTGAAGCAG | 0351 | chr2 | 179398504 | 179399136 |
| TTN_8#1 | GATTGTGTGTTGGAAAATTATCTGTC | 014 | GAATGCCCAACCCTATCCTATG | 0352 | chr2 | 179410041 | 179410682 |
| TTN_10#5 | TCTTCCTCTCCTTGTCTTATCTCG | 015 | TCTTGGAAAGAATGCGAACATC | 0353 | chr2 | 179418396 | 179419027 |
| TTN_13#6 | CATTGAAAGTATGGAAAGGAAGCTC | 016 | TCCAAAACAGCTTTTGTTAACGTC | 0354 | chr2 | 179426939 | 179427599 |
| TTN_13#17 | ATCTTGGCCAACCTGTACACTG | 017 | CTGTGAGAGTTCTGGACACGC | 0355 | chr2 | 179433417 | 179434075 |
| TTN_13#28 | CTTTGGCAATGACCAGTTTCTG | 018 | AAAGTGGCTTTGTGAACGTCAG | 0356 | chr2 | 179439920 | 179440588 |
| TTN_18#2 | CTTTCCAACCCTGCAGGAAG | 019 | TGCACCAGTATAGCTCTCCACC | 0357 | chr2 | 179449499 | 179450149 |
| TTN_1#3 | TTCAGAAAGATTAGTCCGTGTGAAAC | 020 | TCCAGCAGCTTTATGGGAATATC | 0358 | chr2 | 179391664 | 179392251 |
| TTN_3#10 | CAAAAGCACTTGTGTTAATGCG | 021 | CGAGATTCTGTCAACTTAACATGG | 0359 | chr2 | 179399614 | 179400235 |
| TTN_8#2 | TACTGCCCTCACTCGGAATATG | 022 | GAACTGGATGCCCGATTACAC | 0360 | chr2 | 179410608 | 179411215 |
| TTN_11#1 | AAAGCATATGCACAGGTTAGCG | 023 | GGTGCTGAATACAGACCACTGTC | 0361 | chr2 | 179419104 | 179419588 |
| TTN_13#7 | TATGGTCAAATTCACAGGGGC | 024 | GTGCGTGTGATGCCTTGTATC | 0362 | chr2 | 179427534 | 179428171 |
| TTN_13#18 | TGTGACTTTCAGGTTAACAGGTGG | 025 | CTTCTGCTTACCAAAAGGCTTG | 0363 | chr2 | 179434026 | 179434681 |
| TTN_13#29 | ATGTCTGTAGGCCGCAGGTTG | 026 | TTGTTTCTTTCTCAGATCCTCCAG | 0364 | chr2 | 179440519 | 179441158 |
| TTN_19 | CATGTGTTTGAAAGCCACTGTTCC | 027 | TTCTATGTACATTGGAGCAAATCC | 0365 | chr2 | 179451093 | 179451640 |
| TTN_1#4 | CCTCTACCAGTAATTTTATTGCTCACC | 028 | TG CCGTGTAACATTTATTTGCAG | 0366 | chr2 | 179392147 | 179392788 |
| TTN_3#11 | TTTGCTGCCACCATCAGAGG | 029 | GATGCCACAGTTTACCAAGTCAG | 0367 | chr2 | 179400182 | 179400784 |
| TTN_8#3 | TCAGAACCTGCTCTGATGGTAAC | 030 | CGAAGCTTCAAGACCTATAATGGC | 0368 | chr2 | 179411163 | 179411767 |
| TTN_11#2 | GTGGGCCTGGTTTGTCATCAG | 031 | TG CATAGAATTATAATGATGGTGTGTG | 0369 | chr2 | 179419465 | 179420011 |
| TTN_13#8 | AGTGTCCGTCACTTTTGGATTG | 032 | TCAGCAATGTTGGTGGTACAAAG | 0370 | chr2 | 179428113 | 179428807 |
| TTN_13#19 | TGGTTATGTCTATGACTTTGGGG | 033 | TCAAGGTTCTTGACAGACCAGG | 0371 | chr2 | 179434604 | 179435263 |
| TTN_13#30 | TGGTAGTATCAGTGACATGCGG | 034 | CATGTGGCAACCAAACTTATCC | 0372 | chr2 | 179441099 | 179441767 |
| TTN_20#1 | TTTTAGTATGGATTTGCTCCAATG | 035 | GGATGCCCTATTCGTCTCTTTG | 0373 | chr2 | 179451608 | 179452471 |
| TTN_2#1 | GTTTTCTGTGCTTGAAAGAGAGG | 036 | CAGCGATCAGACCCTAACCATC | 0374 | chr2 | 179392920 | 179393507 |
| TTN_4#2 | GCTGGACTTTGTATTTCCCAGC | 037 | TGTGCTCATTGAATCCCTATTTACC | 0375 | chr2 | 179402120 | 179402834 |
| TTN_8#5 | GCGCTTGACACTGGAATTGAC | 038 | GTTGAAGCTGGTCACACCAAAC | 0376 | chr2 | 179412258 | 179412872 |
| TTN_12#1 | GGAAAAGGTATGCGGAAATACTG | 039 | GCTGGAGTTGAAAACCTAGCC | 0377 | chr2 | 179421510 | 179422037 |
| TTN_13#9 | CTCCAGTAACTTTCAGAGGCCC | 040 | CAGAATGCTTTGTTGCTCGTG | 0378 | chr2 | 179428715 | 179429374 |

TABLE 3 -continued

TTN and Control amplimer PCR primers*

| Amplimer | Forward primer | SEQ ID NO | Reverse primer | SEQ ID NO | Chr | Start | End |
|---|---|---|---|---|---|---|---|
| TTN_13#20 | TATGATGTCACTCCCACCATCC | 041 | GGCAAGCCGAGTAAAGTATCAG | 0379 | chr2 | 179435145 | 179435885 |
| TTN_13#31 | CAGGTTCTCCTTTGCCATAGTG | 042 | TTGCAAGGATGAATACGGTAGG | 0380 | chr2 | 179441686 | 179442345 |
| TTN_20#2 | GGTAGAATTGGGGATGACAAGG | 043 | AG CAACTCTTAATCTCAAGCACAG | 0381 | chr2 | 179452325 | 179453234 |
| TTN_2#2 | TTGCTTATGCAGGTGAGGATTC | 044 | CAAAAGTGGAACTGAGAAAGTATTAGG | 0382 | chr2 | 179393439 | 179394100 |
| TTN_5#1 | CCAGGGTTCTACTTAGTATAGAGGGG | 045 | CACAGAATGATGTTGGCCTGAG | 0383 | chr2 | 179403182 | 179403741 |
| TTN_8#6 | CATTCTTGGCCTTCACACGG | 046 | ACCCTCACTGTGGAAAACTGC | 0384 | chr2 | 179412782 | 179413415 |
| TTN_12#2 | CATCAATTGCCAAGACTGGTTC | 047 | GTTGCAAGAACCATGATGAAAG | 0385 | chr2 | 179421986 | 179422507 |
| TTN_13#10 | CATTTCAGTGTGACATTGTTTCTTG | 048 | TCGTTTTAGAAAAGCCTGGACC | 0386 | chr2 | 179429287 | 179429956 |
| TTN_13#21 | ACCGTCATAGGTGGGTTTCTTC | 049 | TATCGTTCTTGACAAACCAGGG | 0387 | chr2 | 179435757 | 179436450 |
| TTN_14#1 | ACATGTTCAACTGTTCTCAGGG | 050 | TGGCACCAAGGAAGGAACTATC | 0388 | chr2 | 179443260 | 179443870 |
| TTN_21#1 | TTTATCGAATACTTCTGTGCTTGAG | 051 | AGCCTGGTCCTGTGAGAAATC | 0389 | chr2 | 179453197 | 179453861 |
| TTN_3#2 | TAAAGGCTTGCCCCATAAATTG | 052 | CACCAAGTGACCACCACAAAG | 0390 | chr2 | 179395204 | 179395819 |
| TTN_5#2 | GGATCTTTGCAAACAACTGGTTC | 053 | GGTGGTAAAAGGCCTCAAAGAG | 0391 | chr2 | 179403678 | 179404227 |
| TTN_8#7 | ACCACTGTTGTTTTCCACAGTAAG | 054 | GAAAATGCTGCAGGAGTTGGAC | 0392 | chr2 | 179413344 | 179413961 |
| TTN_12#4 | ACTTTGGGAAGTGGTTTTCCAG | 055 | TGGTTCAGAAGCAAAATGGG | 0393 | chr2 | 179422854 | 179423522 |
| TTN_13#11 | GAGGTTCCCAAGATATGACTACAAAG | 056 | TGAAAGCTGCTGAACCTCCTT | 0394 | chr2 | 179429870 | 179430535 |
| TTN_13#22 | CTTCCACCATCATACTTGGGTG | 057 | AAGCATCAGAACGACCTCTTCC | 0395 | chr2 | 179436343 | 179437024 |
| TTN_14#2 | AAATTTGATTGGTCCAGTGGG | 058 | GAATATACCTTCAGAGTGAGTGCTGAG | 0396 | chr2 | 179443798 | 179444372 |
| TTN_21#2 | TCTGGTGGATCCCAGCAAAC | 059 | TAAAGTGGCGGAGGCCTGAC | 0397 | chr2 | 179453786 | 179454392 |
| TTN_3#3 | ATCGGAAGCCTGGACTGAAGAG | 060 | AGTCCTCACCCTGGAAATTCTG | 0398 | chr2 | 179395757 | 179396357 |
| TTN_5#4 | GTCTGATGACGCCACCTTGC | 061 | GGTGGCACAGCTAATTTTCAAC | 0399 | chr2 | 179404622 | 179405162 |
| TTN_8#8 | GACCACTGTGGGAGGACCTG | 062 | TTGTGCTCCCATAACCCACTAC | 0400 | chr2 | 179413869 | 179414505 |
| TTN_13#1 | GAATAGTTTGGGGTGTGAAGGG | 063 | CCCAGTGATAGCTCTGACCCTC | 0401 | chr2 | 179423908 | 179424653 |
| TTN_13#12 | ATAAGTGATGCACTGGTCTGGG | 064 | GTGAGGCTACATCAGTTCCTGG | 0402 | chr2 | 179430460 | 179431144 |
| TTN_13#23 | CTAGAATTCGGCTGCCTCCATC | 065 | TGGAACTCCAAAGGCTGAAGAC | 0403 | chr2 | 179436911 | 179437617 |
| TTN_14#3 | AACATCATCCCTTGCCACAAC | 066 | CCCATTATTGATGGCGGAAG | 0404 | chr2 | 179444289 | 179444882 |
| TTN_21#3 | ATGACAGATTTGGACTGCCACC | 067 | GGCAGACCTGAACCAGACATAAC | 0405 | chr2 | 179454345 | 179454948 |
| TTN_3#4 | CGGTAGGTTCCACTGTCATCAG | 068 | AAATCAAGGCGACAAAGAGAAG | 0406 | chr2 | 179396304 | 179396938 |
| TTN_7#1 | GGTTTAGAAACCTGAGAAAAGGAGG | 069 | ACAATGCCTCAGAAGACCATCC | 0407 | chr2 | 179406827 | 179407653 |
| TTN_9 | TACCATTTTACAGGCCAGGGG | 070 | TCCATGGATGATTAAGACCTGG | 0408 | chr2 | 179415608 | 179416052 |
| TTN_13#2 | CAATCAAGGTCTTCCTCATTTCAC | 071 | GGCACTAGATCCATTTACAGTTCC | 0409 | chr2 | 179424563 | 179425230 |
| TTN_13#13 | CAAGGTCAAGTTCAGGTGCTC | 072 | AATCCATTTGTGCTTCCTGGAC | 0410 | chr2 | 179431076 | 179431715 |
| TTN_13#24 | GTAACAACTTTGCGCAGGTCAG | 073 | TTGCAGTGAATCCTTATGGACC | 0411 | chr2 | 179437543 | 179438215 |
| TTN_14#4 | ACCAGGATTTCCTCTCTGCATC | 074 | ATTTTAGGAGTGACAAGGCCAG | 0412 | chr2 | 179444810 | 179445419 |
| TTN_21#4 | CTCGGACCAATACTTTGCCTTC | 075 | GGAACGTCGAGAAGTAACTGGC | 0413 | chr2 | 179454894 | 179455528 |
| TTN_3#5 | TAGACGCAGATGAGGATGATTC | 076 | AAATGGCGTATTCCTAAACTGTCC | 0414 | chr2 | 179396839 | 179397490 |
| TTN_7#2 | CAACTGTGACACGCTCTGATTC | 077 | TATGGCATTGGAGAACCTTGTG | 0415 | chr2 | 179407515 | 179408147 |

TABLE 3 -continued

TTN and Control amplimer PCR primers*

| Amplimer | Forward primer | SEQ ID NO | Reverse primer | SEQ ID NO | Chr | Start | End |
|---|---|---|---|---|---|---|---|
| TTN_10#2 | TGCTGTAACAAGTAATTTCTCCTCC | 078 | AAAGGTGAACAGACGTGGTCC | 0416 | chr2 | 179416843 | 179417413 |
| TTN_13#3 | GAAGTAATTTCCAAAGACGTGGG | 079 | CCACTGGGCCTATTATAGTTAAAGATG | 0417 | chr2 | 179425177 | 179425834 |
| TTN_13#14 | ACAGACGGTCATGGAGTCTTTG | 080 | AGGATGAGGTTGAACTCCCAAG | 0418 | chr2 | 179431641 | 179432305 |
| TTN_13#25 | CCAGCAGACAACCATCGAATC | 081 | GCTATCACTTGCAGGGATGATG | 0419 | chr2 | 179438130 | 179438810 |
| TTN_15#1 | TCTTGGAGTTACCAGCTCTACACC | 082 | CTCACCCATCACTGGCTATTTG | 0420 | chr2 | 179446106 | 179446844 |
| TTN_21#5 | TGAACTTCAGGTCAGCGATAGG | 083 | TGAGCACTACACAGTTGAAACAGAC | 0421 | chr2 | 179455461 | 179456086 |
| TTN_3#6 | GGTCGGTAGTAAAAGTCATAATCAGG | 084 | GAGTCACAGCCACTAACACAGC | 0422 | chr2 | 179397393 | 179398038 |
| TTN_7#3 | TCGACCACTTCTAGCTTTGCAG | 085 | AAGACCACCTCCTGTCATAACG | 0423 | chr2 | 179408062 | 179408751 |
| TTN_10#3 | GGCTAACCTCAATTTCACATGTCTTAC | 086 | CACCATTCCTCAAGTTACTCGC | 0424 | chr2 | 179417353 | 179417936 |
| TTN_13#4 | AACGTCTCGGAACTTGACATCC | 087 | TCAGCTGTTGTTGCAGAGTATCC | 0425 | chr2 | 179425761 | 179426429 |
| TTN_13#15 | TCAAGTCTGAATGTTTCTCCAGC | 088 | CTACAAAGAACCAGGCCCTCC | 0426 | chr2 | 179432218 | 179432898 |
| TTN_13#26 | GCTTCACCTGCTTTTAATATAACCG | 089 | TGCCAACTATCCATTTAAGGTTCC | 0427 | chr2 | 179438722 | 179439402 |
| TTN_16 | TGAATGTCTTCTCCCACATTATTC | 090 | GAAGCAGCATATGAATTTCCCAC | 0428 | chr2 | 179447576 | 179448044 |
| TTN_21#6 | GCCCAGGAACATCAAGAACAG | 091 | TTGGATCCTCTCCGTAAGTTGC | 0429 | chr2 | 179455932 | 179456717 |
| TTN_21#7 | CTAGGGAGACTTCAGTCTTGTCAAC | 092 | TGAAGATGGTGGAATTTATTCTTTAAC | 0430 | chr2 | 179456557 | 179457185 |
| TTN_29#4 | TGGTTCATTCCATTTCACTAGCATAC | 093 | CCACAAATCATGTCAGAGGAGC | 0431 | chr2 | 179473128 | 179473732 |
| TTN_34#1 | TTGTATGGCATCCCAACCTTC | 094 | CACTGCAAACTCATTAACTTTTCTTC | 0432 | chr2 | 179481130 | 179481773 |
| TTN_44#1 | GCTGCTTTCATGCAATATAACACTTAG | 095 | AGGAACCCAGGAAATCACAGG | 0433 | chr2 | 179496767 | 179497407 |
| TTN_54 | GAGCAAGGAGTCAGGTAAAGGG | 096 | CAAAGCTTGGTTTTGATTCTTGG | 0434 | chr2 | 179509215 | 179509435 |
| TTN_85#1 | GGAGATGAACAAAAGGATGGG | 097 | GTGATCACAGAATATTTGCCTTTC | 0435 | chr2 | 179542272 | 179542740 |
| TTN_109 | CCTTCCTTCACCCTCCACTG | 098 | CCTGAAAGCATTTTAGTTACTTACACC | 0436 | chr2 | 179563485 | 179563709 |
| TTN_121#2 | CTACAATTGTTGCAGGCTCTGG | 099 | TTATCACTAGTTTGATTCCCGGC | 0437 | chr2 | 179578885 | 179579394 |
| TTN_21#9 | TCATCTCCAACTTTCTGGTACTCAAC | 0100 | TGAAAGCCAAAGATCGTTTCAG | 0438 | chr2 | 179457672 | 179458315 |
| TTN_30#1 | TGCTGAAGCTATGTCCCATTTC | 0101 | GAGTTGCCACTTTCCCATTTTG | 0439 | chr2 | 179473832 | 179474393 |
| TTN_34#2 | GGCCTTGGATAGCCTGTACTTG | 0102 | TTTTAGAAACCCAGACTGTGCCTAC | 0440 | chr2 | 179481641 | 179482380 |
| TTN_44#2 | AAAAGCAGCTGACTTGATCACC | 0103 | GAGGGGTTGCTTGGTTGTGTAG | 0441 | chr2 | 179497320 | 179497884 |
| TTN_56 | CCACAGTTGACATGAGAGAAACAG | 0104 | TGCATCAATGTGAAATTTGTATGAG | 0442 | chr2 | 179511025 | 179511367 |
| TTN_88#1 | CTCACCAAGTTATGCTGCATGG | 0105 | AGTGGTGCCAGTGATACCAGTC | 0443 | chr2 | 179544001 | 179544646 |
| TTN_110-111 | AGGGCCAATGCGTTGTATTAAG | 0106 | TTCTGCCATTAGATATGCCTGAC | 0444 | chr2 | 179565760 | 30 |
| TTN_122 | GATAAGACTGGGCTGGGGTG | 0107 | TCTCTCTGATGGAGTGGAAGATTG | 0445 | chr2 | 179579626 | 179580077 |
| TTN_23 | TCTCATGATGTGAAATGGTCAGC | 0108 | CAAAGCTATGCTGTATGCTGTGTAAC | 0446 | chr2 | 179461750 | 179462205 |
| TTN_30#2 | GGGGCATCTATAGTGATCATAACC | 0109 | TTTTGTTTTAAGAAGGTGGTTTTCC | 0447 | chr2 | 179474291 | 179474768 |
| TTN_35#2 | TCAACTCCTCCTTTCTGTAGACCAG | 0110 | GCATAATAACATGATGTAGCTTGGC | 0448 | chr2 | 179483005 | 179483650 |
| TTN_44#3 | TGTTTGGAGTGAGGGTTAGAAGG | 0111 | GACAAACTGCAGTGGAGAAGG | 0449 | chr2 | 179497773 | 179498371 |
| TTN_60 | ATGCAACAACAATGAGGACAAC | 0112 | ACTTTGGACCCACAGAATTTGG | 0450 | chr2 | 179514192 | 179514745 |
| TTN_88#2 | AGTAAGCAATCATTGGTGCTGC | 0113 | TGAAGCTCAGAATCCTTTCCAC | 0451 | chr2 | 179544515 | 179545232 |
| TTN_112 | CTAGCATCAGCTGAGTGAGACC | 0114 | CCCAGACGATGAAGGTGATTTC | 0452 | chr2 | 179566543 | 179567194 |

TABLE 3 -continued

TTN and Control amplimer PCR primers*

| Amplimer | Forward primer | SEQ ID NO | Reverse primer | SEQ ID NO | Chr | Start | End |
|---|---|---|---|---|---|---|---|
| TTN_123 | AAGAATCAATCTTCCACTCCAT CAG | 0115 | CATTTAACTCTTCTTCCTTGAA CTGC | 0453 | chr2 | 17958004 | 17958045 |
| TTN_24 | TTGTTACACAGCATACAGCATA GC | 0116 | GGAAGCCATTAAAGCAAGAAG C | 0454 | chr2 | 17946217 | 17946285 3 |
| TTN_30#3 | ACATCTACAGGTGGATCAGGG G | 0117 | AGCCCCACTTAGAGACAAGTG C | 0455 | chr2 | 17947468 | 17947519 5 |
| TTN_36#1 | GAAATGAAAGACCCTCACAAG G | 0118 | TTGCAAGCTAACTGATAATCCA ATG | 0456 | chr2 | 17948424 | 17948487 4 |
| TTN_44#4 | TCACCATCTTTGAACCATTTCA C | 0119 | AATGGGTCCCTTTTACTCAGGC | 0457 | chr2 | 17949828 | 17949889 9 |
| TTN_61 | TTCTGTGGGTCCAAAGTTTTAT G | 0120 | CAAAGAAGTCAGTGCAAATGA GATAG | 0458 | chr2 | 17951472 | 17951516 4 |
| TTN_89#1 | GGCTAACAGGCTATGGATGTA TTTAG | 0121 | AAGTGCTGAAGAAAGCTGTCC C | 0459 | chr2 | 17954559 | 17954618 0 |
| TTN_113 | TGAGCGCATACAGGGTAGAAA TAC | 0122 | GCTACATTCGACCAGCATGAAT AC | 0460 | chr2 | 17956710 | 17956761 8 |
| TTN_124#1 | CTCTCTCTCAAGCACACCCACC | 0123 | GTGTCTTGGTACAAGGATGGG G | 0461 | chr2 | 17958173 | 17958243 0 |
| TTN_25#1 | ACAGAAGTTAATGGGATTGAG AATAAC | 0124 | AGAGCCAGAATATGATGGAGG C | 0462 | chr2 | 17946315 | 17946371 9 |
| TTN_31#1 | GCACTGCAAAGTTAACTAATTT CCTC | 0125 | GATGCTGGGAGAAAACACATT G | 0463 | chr2 | 17947565 | 17947636 9 |
| TTN_36#2 | ACTCATCATCCAGCCTGCAATC | 0126 | GAAGACCTTAGGATTGTTGAG CC | 0464 | chr2 | 17948477 | 17948535 0 |
| TTN_47#1 | TGTAATACTGGGAAACAGAGGT CC | 0127 | AAGACCTCCACGGCTAAACTT G | 0465 | chr2 | 17950060 | 17950115 5 |
| TTN_72 | AAAGGTGGTCCTTTCTATCGCC | 0128 | GTGGAACAAAGGGAGGATGGA G | 0466 | chr2 | 17952912 | 17952974 5 |
| TTN_91 | GGAACTAGAAGGCAAAGAGCC AG | 0129 | TGTCTTTGTCCTTGAATTGTTT G | 0467 | chr2 | | 17954811 3 |
| TTN_114#1 | CACAACATTTGCCATTGACC | 0130 | CAACTTAAAGACCAGGGCAAT TATC | 0468 | chr2 | 17956881 | 17956935 09 |
| TTN_124#2 | ATACTGCCCTATGTGGCTCTG G | 0131 | GCCTGATAGAAAATGAGGCTG G | 0469 | chr2 | 17958231 | 17958311 05 |
| TTN_25#3 | CCATCATCTTTAGGTGGAAACC | 0132 | TCTGCCTACAGTGGATCCAAA C | 0470 | chr2 | 17946408 | 17946462 80 |
| TTN_31#2 | TCCATTTCTCAGTGCCTACTGG | 0133 | TATTTTCAGCCACTCCTGGACC | 0471 | chr2 | 17947625 | 17947688 98 |
| TTN_36#4 | TTTTCTGAAAGCAACCGACAAG | 0134 | CGGAAGAGAATCCTGGTCATT C | 0472 | chr2 | 17948571 | 17948637 04 |
| TTN_47#2 | TGCAAGTTGCTACTAAGGTTTG TTAC | 0135 | TGCTTTACGGCTGGTTTTATCC | 0473 | chr2 | 17950105 | 17950166 22 |
| TTN_74 | TTGGTTGAGCTTCTACTTGGG G | 0136 | CCAAGAAAGTCAAGTCCCACA C | 0474 | chr2 | 17953140 | 17953187 02 |
| TTN_94 | CCACCAACATATAAACAGTATG ACCC | 0137 | AAAAGTGAATGCTAAGCCCCA C | 0475 | chr2 | 17954929 | 17954975 96 |
| TTN_114#2 | TAGCGCTAGCGATGTGTGGAC | 0138 | ACCTAACCAGCATCCAGAATG G | 0476 | chr2 | 17956925 | 17956977 91 |
| TTN_124#3 | TCAGTCATGCCATGTAAAAGA GG | 0139 | GAATGAGCCTCACATTCACCA G | 0477 | chr2 | 17958297 | 17958368 52 |
| TTN_26#2 | CTGGATTGACTTTGGTCCAGG | 0140 | GGAATTTGATGGAAAGGCAAA G | 0478 | chr2 | 17946613 | 17946670 62 |
| TTN_31#3 | TCGTTTTGTCACATCAACCAC | 0141 | TTCTAATATCTGCCTGTGAGCT ACG | 0479 | chr2 | 17947684 | 17947740 64 |
| TTN_37 | AAGTAAAGTGGTGACCAGAGA AGTTG | 0142 | GGCAGCTTCAAGTGATTTCAAA G | 0480 | chr2 | 17948728 | 17948761 43 |
| TTN_48 | TTCCCCTTGAATATGAACTTTG G | 0143 | TTTATAATGGAGCATGACTCAC CC | 0481 | chr2 | 17950202 | 17950223 41 |
| TTN_77 | TGTGGCATTGAGAAGAGAAAG G | 0144 | TGTTTATATCTCTCATGCTCTG CTTG | 0482 | chr2 | 17953485 | 17953516 01 |
| TTN_96 | TGGTAGATGTTCACTGAATTTG TGTC | 0145 | CCATGAAGCTATGTCCTAAGCA G | 0483 | chr2 | 17955271 | 17955306 9 |
| TTN_117 | AG CCTACAAATTG CAGATGAG C | 0146 | TTGTCTTTAGAGAGGAATAAAC CAGG | 0484 | chr2 | 17957212 | 17957269 8 |
| TTN_124#4 | GCTGCCTTTAAACCACTTGACC | 0147 | GCACTGTATCCGTCCATGTTTC | 0485 | chr2 | 17958358 | 17958434 04 |
| TTN_26#3 | TCCATCCTATTAGAAAAG GAGA CAG | 0148 | AAGACTCCAGCACTTCATCAGC | 0486 | chr2 | 17946663 | 17946738 0 |
| TTN_31#4 | TCATTAAGAAGTAATGTAGCCA GGAGG | 0149 | AAAATAAACATAGGCTTCTTCT GCTTC | 0487 | chr2 | 17947737 | 17947807 69 |
| TTN_40 | GCAGGAGCTAGTTATTTACCAA AGC | 0150 | GTTTGATTAACCAGAAGGCAG G | 0488 | chr2 | 17949336 | 17949374 45 |
| TTN_49-50 | GGGCTTGAATTTTAATCAAGTG TG | 0151 | CGTGGGCTTAATTTTAGTTTTG AC | 0489 | chr2 | 17950434 | 17950494 19 |

TABLE 3 -continued

TTN and Control amplimer PCR primers*

| Amplimer | Forward primer | SEQ ID NO | Reverse primer | SEQ ID NO | Chr | Start | End |
|---|---|---|---|---|---|---|---|
| TTN_78 | TTGGTAGAACTTCCCTTGGACC | 0152 | ATGTGTAATATGAAGGAATGTGTGTG | 0490 | chr2 | 17953564 | 179536121 |
| TTN_97 | TGTGGAAGAAGAAGAGACTTTGAGG | 0153 | GGTGTACTGTGCAACTCTTCCC | 0491 | chr2 | 179553335 | 179553595 |
| TTN_120#1 | GGATTACTTAAGCAGAATTTTAAGCC | 0154 | CCCATTTCGGTTACCTGGAAG | 0492 | chr2 | 179576548 | 179577231 |
| TTN_124#5 | ATGTGGGAAGGGTAGTTTTGC | 0155 | TGATAACATTGCAACCCTCCAG | 0493 | chr2 | 179584181 | 179584828 |
| TTN_29#1 | AGACTGTTGGGAGTTTGAAGCC | 0156 | GAGCTGGATAAAGACCGTGTTG | 0494 | chr2 | 179471654 | 179472281 |
| TTN_32#2 | TCTGCAGCAACTCTGAAGATG | 0157 | TTGAAAATGTCCCTAAGAAATCCAC | 0495 | chr2 | 179478841 | 179479321 |
| TTN_41 | GCGGAAAGAGAAAGGCAAAG | 0158 | GAACCCTTAAAGACCACTTCCC | 0496 | chr2 | 179493903 | 179494675 |
| TTN_51 | GAGTGAGATGGTAAAGAAAATTAAGCC | 0159 | GGGAGTGGAAGATAAGTGGATGG | 0497 | chr2 | 179505125 | 179505561 |
| TTN_80 | GAGGGATCCATTGCTATGTGATAAG | 0160 | CACCTCTAGGGTTCCTACTCCAC | 0498 | chr2 | 179538078 | 179538596 |
| TTN_99 | GGGTGGACAGACACTTTTGTTC | 0161 | GATTTGTGCATGTGCCTATGTTC | 0499 | chr2 | 179554401 | 179554699 |
| TTN_120#2 | TGTCCTGCATCCTCTACTGTGC | 0162 | TCCCATGGATGTTTTAACTGGG | 0500 | chr2 | 179577107 | 179577674 |
| TTN_124#6 | AATTAGATGCTTCTGGACTCCCC | 0163 | TTTCTTGTGTCAGCATGTATTGTC | 0501 | chr2 | 179584782 | 179585513 |
| TTN_29#2 | GCCATGGTCTTTTCGCAGTG | 0164 | GGGGAAATTGTTGGCTATTTTG | 0502 | chr2 | 179472195 | 179472719 |
| TTN_32#3 | AAGACGTTCACTTCCACCACAG | 0165 | CTGCTGAATGTACTGCCTGCTC | 0503 | chr2 | 179479195 | 179479895 |
| TTN_42 | TTTGAACCACTTCTGTATTGGAATG | 0166 | GTTTCATCACCATTTATTTGTTGC | 0504 | chr2 | 179494801 | 179495205 |
| TTN_52 | AGAAAGCAGACAATGGAAAACAG | 0167 | TCGGTGTAAATGCTTACTTTCCAG | 0505 | chr2 | 179505816 | 179506188 |
| TTN_81 | GCTACTGAGAAAGATTTGGAACACC | 0168 | TTTACACAAGCGTTTCGAAGG | 0506 | chr2 | 179538978 | 179539242 |
| TTN_106 | TTACGCACAACTTTGAACTCTG | 0169 | CTGCTTGATCCTGCTTCAAATC | 0507 | chr2 | 179559807 | 179560310 |
| TTN_120#3 | TCACTGCTACCTTTGAACCAGC | 0170 | AAAAGAGCCAAATGGATCTAGGG | 0508 | chr2 | 179577579 | 179578223 |
| TTN_126#1 | TGTTGCCTCCAACACTAATACA | 0171 | ATTAAATGGCTCTGCACCCATC | 0509 | chr2 | 179586434 | 179587191 |
| TTN_29#3 | CATTTGTGCCAACCAACTGC | 0172 | ATGCACCAGATAAGCCCATTG | 0510 | chr2 | 179472671 | 179473195 |
| TTN_33 | TTAAATTTTCCCCAACAAAGCC | 0173 | CTGCAGTTTGTATCCCTGGTC | 0511 | chr2 | 179479959 | 179480608 |
| TTN_43 | TCCTGCATCCACTCTGACTTTC | 0174 | TTCCAAGAGATTGTCATTTCCC | 0512 | chr2 | 179495447 | 179496092 |
| TTN_53 | GCGAACCAATTCAAAGAAAACC | 0175 | TGCAGCGAAAATTGTTACTTAATG | 0513 | chr2 | 179506859 | 179507164 |
| TTN_83 | TGAGTGTCCTGTGTGGATAGAACC | 0176 | ACAGACCTGTCTTGAGCGACTG | 0514 | chr2 | 179540324 | 179540838 |
| TTN_108 | GAGGAGACTCCACAACTTTCAATAAG | 0177 | GGAAGGGCTGGTGTATGAGTAG | 0515 | chr2 | 179561734 | 179562024 |
| TTN_121#1 | TTGCTGATTCAGAAGATGTCGG | 0178 | CAGATACAAGGCACACACTCACC | 0516 | chr2 | 179578499 | 179578994 |
| TTN_126#2 | GTGGGTTGGAAGCTGAGCAAG | 0179 | TTCCTTAGAACCGCCTTATTTTG | 0517 | chr2 | 179587025 | 179587672 |
| TTN_126#3 | CTCCAGAGGTTCCAGTTCCG | 0180 | AGTGGGGAATACACCTGTGTGG | 0518 | chr2 | 179587627 | 179588217 |
| TTN_129#9 | TGGGTGGTTCTGAAGAAGGG | 0181 | TTGCCCAGCTCAAATTTTATTC | 0519 | chr2 | 179597437 | 179598076 |
| TTN_134#4 | GAAATGCTCATTTGGTGTACCG | 0182 | AATCACTTCAATGGAGGTGGAAG | 0520 | chr2 | 179611683 | 179612325 |
| TTN_136#2 | TCTGCAATTTGTGAAAGGGATG | 0183 | AAGGAACCAGATACTGCATGGC | 0521 | chr2 | 179621275 | 179621770 |
| TTN_147#5 | CAACTTCAACATTTACTTTGCATCTTG | 0184 | GATTCTGGGGAATGGACTGTG | 0522 | chr2 | 179641643 | 179642222 |
| TTN_170 | CTACCCCATGGCTCTGTG | 0185 | CTGCAAAGCAGCTCCAGAGT | 0523 | chr2 | 179668899 | 179669447 |
| TTN_17b | TTTTTATTAGGAAAAATGACCATCA | 0186 | CAGGGATGATAATGTGAAATATG GA | 0524 | chr2 | 179446264 | 179448712 |
| TTN_3#9b | GCTGGAGAGCCTCCGATG | 0187 | CACAAGTGCTTTGAACTTAATGAAAG | 0525 | chr2 | 179399134 | 179399627 |
| TTN_126#4 | AAACCTTTCACAAAGAGACGGG | 0188 | TCATCACCTATTTCAGTTGCCTG | 0526 | chr2 | 179588141 | 179588778 |

TABLE 3 -continued

TTN and Control amplimer PCR primers*

| Amplimer | Forward primer | SEQ ID NO | Reverse primer | SEQ ID NO | Chr | Start | End |
|---|---|---|---|---|---|---|---|
| TTN_130#1 | TTCTTCCATGGGGTAAGAAGC | 0189 | TCATGTGAAGCAGTGAATGACG | 0527 | chr2 | 179598987 | 179599494 |
| TTN_134#5 | GTGGACGACCTAGTGATTCCTG | 0190 | TTGTCCTCTAGAAAATGGAGGC | 0528 | chr2 | 179612240 | 179612871 |
| TTN_137 | CAGTATGCAATAAAACAAACAGCAG | 0191 | AAGGACAAGGCAGTAGGAGTGG | 0529 | chr2 | 179622171 | 179622775 |
| TTN_148#1 | GCCATTTTAGCCCTCGATTTTC | 0192 | TCATAGCTCCTTGCCACAGTAAAG | 0530 | chr2 | 179643495 | 179643937 |
| TTN_13#32b | ATGGACCTACCGTATTCATCCTT | 0193 | TGTATAAATAATTTGGGCAACACA | 0531 | chr2 | 179442319 | 179442993 |
| TTN_90b | TTGGGTATCCAAATTTTTATCTTG | 0194 | GCAAAAGAATAAAATCAAAGCACATT | 0532 | chr2 | 179547323 | 179547722 |
| TTN_163 | AGAAAATCTATTCAAATGCGAGGTG | 0195 | TCAAGGTAGGAAGGCAAAGAGTG | 0533 | chr2 | 179658624 | 179658861 |
| TTN_126#5 | GTGGTTTGGTACTTTGCTCCAC | 0196 | CCATCTCACTGGGAGAAACAATC | 0534 | chr2 | 179588708 | 179589360 |
| TTN_130#2 | TGAAAGCATTGTGTAAGTAATGGG | 0197 | TGTGTGTTGGGTCTCTTTGTTG | 0535 | chr2 | 179599345 | 179599813 |
| TTN_134#6 | AAAGGCTTTTCCTCACTTGCTG | 0198 | CCTGCAATTTCTAAAAGAGCTGAAC | 0536 | chr2 | 179612800 | 179613449 |
| TTN_139 | TTGTGATG GAG GAGAAGCTGAC | 0199 | CTACATGCTCCCTTCTGTGAGG | 0537 | chr2 | 179628817 | 179629099 |
| TTN_38b | TCTTTAAACACATAAAGGATCAGGT | 0200 | AAAGTTGAGAAGGTACCAAAACTCT | 0538 | chr2 | 179489030 | 179489529 |
| TTN_175 | TAGAATTAGTAAACTAGTCTTGTGGAAACC | 0201 | CATTGAATATTGTGCTTAAAGAGAGAA | 0539 | chr2 | 179674426 | 179674625 |
| TTN_153 | GAAACTGATCTTTGCAAACGTGTAT | 0202 | CATGAGCTAAGAGTTTATGAGATTTCC | 0540 | chr2 | 179648366 | 179648583 |
| TTN_154 | CACCTGGCCCTGCTCAAT | 0203 | GGGCTAGCCATCGGAGGAT | 0541 | chr2 | 179648740 | 179649136 |
| TTN_127#2 | GATTGTCCAGATCATGCGAGAG | 0204 | GTGCTGGACTCTACTTACCCATTAG | 0542 | chr2 | 179590412 | 179590896 |
| TTN_131 | AAAGTGTACTGACTGAATTGTTTG CC | 0205 | CTTAACTCATCTTTTCTCTGTCTTGG | 0543 | chr2 | 179600146 | 179600893 |
| TTN_134#7 | TGTGTTTTATTTGAGTGTGAAACTGC | 0206 | CCAAGCAGAGGGTACTGTTTATCC | 0544 | chr2 | 179613371 | 179614008 |
| TTN_140 | CACTGGGAAAGGACAAAAGCC | 0207 | GAGTTTTGCATGCTCTCTTGTG | 0545 | chr2 | 179629186 | 179629604 |
| TTN_164 | TGAGTTAATGTGCACTGAAGGA | 0208 | GGTGGCTCAGTTTTCCAGT | 0546 | chr2 | 179659065 | 179659364 |
| TTN_87 | AAAGAGTTGCATCCCAAAGAG | 0209 | ATTGCCAGCCTTAAAATCTTAGC | 0547 | chr2 | 179543376 | 179543625 |
| TTN_100b | GGCAGCATAGTACATATGAAGATCG | 0210 | TGTAATCTTAGATGTCTCAGAAGGTGA | 0548 | chr2 | 179556658 | 179556894 |
| TTN_10#1c | AGCATTCCTTGATATATTGTTTCTAA | 0211 | ACCTGAAGATAATGGAGGAGGAGA | 0549 | chr2 | 179416284 | 179416883 |
| TTN_128#1 | TAATACCCAGGGGAGAAGGTGG | 0212 | TTTCTGTCTGACTGTGTCTTTGG | 0550 | chr2 | 179591757 | 179592287 |
| TTN_132 | TTTCCCACACATGTACAGAAAGC | 0213 | CACCAATTTCAACTGTTTTACTCC | 0551 | chr2 | 179602728 | 179603198 |
| TTN_134#8 | CATTTTCCTTTTCTGATCTACCAAG | 0214 | AGAGAAGGGGATTCCATCATTC | 0552 | chr2 | 179613896 | 179614616 |
| TTN_144#2 | TGGACTTTCCTTTCTGAGACCAG | 0215 | CAGGACTTCTTTTCCTTGATGATG | 0553 | chr2 | 179634882 | 179635466 |
| TTN_128#2b | ACCAAAGACACAGTCAGACAGAA | 0216 | AATGTCCATAAAACTGTCACAATAAT | 0554 | chr2 | 179592264 | 179592663 |
| TTN_79#1b | TCTTCCAAACTGAACACAAAATTTAC | 0217 | TAGATGCTCTTTCAGGGAGAACT | 0555 | chr2 | 179536612 | 179537009 |
| TTN_141b | TTACAAGAATTTAGTGACTTAAACAGGA | 0218 | GGGAGGAAACCAGAGCTTCAA | 0556 | chr2 | 179631029 | 179631404 |
| TTN_102c | GTATGCACACTGTGACTAAATCTATTATT | 0219 | TCATTTCATGTTTGTCTCTGTTTTC | 0557 | chr2 | 179558225 | 179558524 |
| TTN_129#1 | ACAAAGGCAAGAGTGATACATTTAAG | 0220 | ATGACCTTGGAATGTGTTGTGG | 0558 | chr2 | 179592766 | 179593449 |
| TTN_133#1 | AAGTGAAAATTTAAGTGATGCAAGC | 0221 | AACAAGTTTGCAAGAAGAAATGG | 0559 | chr2 | 179603784 | 179604460 |
| TTN_134#9 | CAACTGCCCCTGAATTGTTTC | 0222 | ACATGCCAATCCCACGTAATC | 0560 | chr2 | 179614406 | 179615185 |
| TTN_146#2 | CTTCGTCTGAAGCATGAGTTCG | 0223 | GAGGGTGACATTGTTCAGCTTG | 0561 | chr2 | 179638246 | 179638790 |
| TTN_166 | AGAGACATGTGCTTTTAAGTTTCAC | 0224 | GATTTTTGTTGTAGAGTAAGGCAAAC | 0562 | chr2 | 179661384 | 179661659 |
| TTN_92b | GATTAGTTTTAGTGTCTGGATGCTT | 0225 | TGTCAAGTGTTTATGTTTGGGCTAC | 0563 | chr2 | 179548664 | 179548904 |

TABLE 3 -continued

TTN and Control amplimer PCR primers*

| Amplimer | Forward primer | SEQ ID NO | Reverse primer | SEQ ID NO | Chr | Start | End |
|---|---|---|---|---|---|---|---|
| TTN_39b | TGGCATTGTTCATGAGCCTCT | 0226 | AAATGCACCCATATACTAGATTGC | 0564 | chr2 | 179489942 | 179490180 |
| TTN_104c | ATGTTTTGATCTATAGGGACAAACAATGC | 0227 | ATTAGTAGTTTGCTAACTTCACTATGC | 0565 | chr2 | 179558889 | 179559085 |
| TTN_129#2 | TGGGAACTATTTGTTTCCCGTC | 0228 | TTGCCCTGAAAGGTCAGTTATAC | 0566 | chr2 | 179593371 | 179594026 |
| TTN_133#2 | AACTTCTGGTTCAGTAATGGGTTC | 0229 | AGAATTGAGGAAGGCAAGTCC | 0567 | chr2 | 179604388 | 179604999 |
| TTN_134#10 | TTCCATATTGGTTAAATAGCACACAAG | 0230 | AGCCAAGAAGCACTGGTAAAGG | 0568 | chr2 | 179615057 | 179615702 |
| TTN_146#3 | CACAATGTGAACCCTGTCACTG | 0231 | GGGGAGATAAAAGACATACAAGACATC | 0569 | chr2 | 179638683 | 179639296 |
| TTN_101b | GATGCTATTTGTTAATACACAGATCTTA | 0232 | ACAACAACATATGCCTTGTCAAA | 0570 | chr2 | 179557138 | 179557367 |
| TTN_12#3b | AACTGTTGCAGACACTTCAGTCC | 0233 | TGACCTTATCAAGAGATGGTGTC | 0571 | chr2 | 179422505 | 179422854 |
| TTN_73b | GAAACCATAGTTTTAAGAGCAGAGGAC | 0234 | AAATATCACTTTGGTTCAGCTCATTT | 0572 | chr2 | 179530037 | 179530270 |
| TTN_115c | TTCTGGTAATTCAAAGGGAATATGTG | 0235 | TTGAATGATGATAGACAATTAAAAATAAG | 0573 | chr2 | 179569822 | 179570156 |
| TTN_129#3 | AATGAATGATGGTGGTTCTGTG | 0236 | AAGCCCAGTCCAGTCTTAGTGC | 0574 | chr2 | 179593880 | 179594652 |
| TTN_133#3 | CAGTACCTGCTTTTCTTCAAGTGC | 0237 | GGGAATTTCTTTGCATCAATGG | 0575 | chr2 | 179604940 | 179605574 |
| TTN_134#11 | TGTCCTCTTGCTTGGGTATTTTC | 0238 | GAGGCTTTAGTTGAAAGGGGAG | 0576 | chr2 | 179615614 | 179616266 |
| TTN_147#1 | TTTTACCACATGCTAAGGGTGAC | 0239 | TGGTCATAAGAGATGTGACTGCTG | 0577 | chr2 | 179639582 | 179640184 |
| TTN_5#3b | CAGAGATGTACCTCGGACTCTG | 0240 | CAGACTTACCATACCAATCAAAGG | 0578 | chr2 | 179404227 | 179404626 |
| TTN_129#5b | TTTGACTGTCAGATGCCCACT | 0241 | GCAGCTGCAAGGCTAGAAT | 0579 | chr2 | 179595233 | 179595681 |
| TTN_169 | TCCCAATTTGCTGGAGATGT | 0242 | GCAGTGAACATGATGGGACAG | 0580 | chr2 | 179666803 | 179667147 |
| TTN_119#1c | CACCTTCAGGCTATACTACAAAATGA | 0243 | AATCAAATATGAACTTAGGGAGAAAT | 0581 | chr2 | 179575298 | 179575744 |
| TTN_129#6 | CAGCTGCTCCTCCCAACATC | 0244 | GTTGGTTCCAGTGAGGGACTG | 0582 | chr2 | 179595675 | 179596413 |
| TTN_133#4 | AGGTTGGGAGATGGTTCCTTG | 0245 | AATTCGCTGTGCTCAAGGGC | 0583 | chr2 | 179605511 | 179606122 |
| TTN_135#1 | AAGTCCATGCCAAACAAACTATTG | 0246 | CAGGATACCACGTGGACTGAAG | 0584 | chr2 | 179618041 | 179618540 |
| TTN_147#2 | GACTG GAG GTTTCTCCAGCTATG | 0247 | TGTTGACACCACTGAAACCAAAG | 0585 | chr2 | 179640104 | 179640690 |
| TTN_93b | GCCCCCATAACCAGTGTATT | 0248 | TCTAAAATCACAGTACTTTCTGGCTAGT | 0586 | chr2 | 179548982 | 179549223 |
| TTN_103b | GACAACAAGAGGGATAAAAATCTGC | 0249 | TCTAAATACTTGAGTATAAAATCCATGTG | 0587 | chr2 | 179558578 | 179558824 |
| TTN_162b | GGTAAAGGTGATTATCTGTGTTGACC | 0250 | CGAGGCTGGTCTTGAACTAATTT | 0588 | chr2 | 179658061 | 179658340 |
| TTN_125c | CTCATAACTTTGCTAAGAGCCCAAA | 0251 | ATGGGATCTTCAGCTACAAAAACAA | 0589 | chr2 | 179585581 | 179586011 |
| TTN_129#7 | GGGAGCTGGTACTCTCGATCTTC | 0252 | GAGAAATTAAGGAGAGCAGCAAAC | 0590 | chr2 | 179596269 | 179596951 |
| TTN_134#2 | TTGATAAACCTGGGAGGCCC | 0253 | TCAAGAAATTGTCCTGGAAGTTG | 0591 | chr2 | 179610574 | 179611206 |
| TTN_135#2 | TTCCAAGGAATATGCACAGC | 0254 | GAATGTCAAACCCCTGGAAGTC | 0592 | chr2 | 179618431 | 179618938 |
| TTN_147#3 | TTTCATGGGTAATTCTTTCAGCC | 0255 | TGAGAAAGTCTTGTGGAAGAATCC | 0593 | chr2 | 179640626 | 179641203 |
| TTN_84b | TTTTCCTAAAACCCAGTTTCATCA | 0256 | GTTTGTGGTCTTATCCTCACG | 0594 | chr2 | 179541847 | 179542119 |
| TTN_160 | TGATGAAAATGTAGGTGATTTGC | 0257 | CATCCTGTATTTTCCTGAGTGTTTC | 0595 | chr2 | 179655364 | 179655663 |
| TTN_21#10b | CATACTGAAACGATCTTTGG CTTT | 0258 | CCTGGTTCAAAGATGAAGCTGAT | 0596 | chr2 | 179458290 | 179458864 |
| TTN_127#1c | GCCAGTAACTCTTAGTAATTCATTCCA | 0259 | CATGATCTGGACAATCTTTTCAC | 0597 | chr2 | 179590028 | 179590427 |
| TTN_129#8 | ACCACTGTCTTCGATGCCAAC | 0260 | TCATCTTCCCTTAGATCAACCCTC | 0598 | chr2 | 179596860 | 179597507 |
| TTN_134#3 | CGGGAACTGTCACTATTTTCACC | 0261 | TCCTACTGGAGGACCAAACCC | 0599 | chr2 | 179611124 | 179611770 |
| TTN_136#1 | TTGAATTTGCATGGCAGAAAAG | 0262 | CTCAAAGTTCCATCCACACAGC | 0600 | chr2 | 179620872 | 179621353 |

TABLE 3 -continued

TTN and Control amplimer PCR primers*

| Amplimer | Forward primer | SEQ ID NO | Reverse primer | SEQ ID NO | Chr | Start | End |
|---|---|---|---|---|---|---|---|
| TTN_147#4 | TTCTCTGTAAGCCTTTCCTCCC | 0263 | TCTGCCTGGTATACTGCGACTG | 0601 | chr2 | 179641145 | 179641718 |
| TTN_118b | GCTCATGGATATATAACAGGCAGTG | 0264 | AGTTGGTTAGCCTTGATTTTAAC | 0602 | chr2 | 179574228 | 179574697 |
| TTN_143b | CCCACATTTTATTTATCCATTCATT | 0265 | CCTCAACAGACGCACTAAAAACA | 0603 | chr2 | 179633304 | 179633769 |
| TTN_155 | AATCCTCCATTGGCCTACCC | 0266 | CATCTGCCTGTCCTGATGC | 0604 | chr2 | 179650252 | 179650951 |
| TTN_129#10c | AAAATTTGAGCTGGGCAACAT | 0267 | AAAACTCTTAAATATAGATGGTGTTGAAAG | 0605 | chr2 | 179598059 | 179598694 |
| TTN_134#12c | CCTTTCAACTAAAGCCTCCACA | 0268 | TAAACAGAGCATGGTGTTGC | 0606 | chr2 | 179616249 | 179616939 |
| TTN_158c | ATTTCACATGATATGTGGTATTAATGT | 0269 | GGAAGGGGGAAGGGTCATACTA | 0607 | chr2 | 179654019 | 179654299 |
| TTN_27c | AAGGCAGAATTATCCATTTAGTGA | 0270 | TACAGTCATCCCTCCCAAAATAAGTT | 0608 | chr2 | 179468534 | 179469129 |
| TTN_79#2c | GACAGTTCTCCCTGAAAGAGCAT | 0271 | GTAATGTTGGCGTTGTCTCTG | 0609 | chr2 | 179536984 | 179537516 |
| TTN_21#11b | CATCTTTGAACCAGGAAACCTTAG | 0272 | GGAATATTCACTACATCCTACTACATTCTT | 0610 | chr2 | 179458850 | 179459449 |
| TTN_3#1b | TCAAATGTGTGTTTCTGCTTTGG | 0273 | ATTTATGGGGCAAGCCTTTAAGA | 0611 | chr2 | 179394524 | 179395223 |
| TTN_134#1c | GAGTCCATTCCACTGAAACACTTT | 0274 | GGTTTATCAAAGGTATTTCTGACTG | 0612 | chr2 | 179609984 | 179610583 |
| TTN_159c | AGGGATTTTAAAAGGCAAATACA | 0275 | GCCTCCTTTCTTTTTGACTTACG | 0613 | chr2 | 179654593 | 179654928 |
| TTN_28#1 c | ATGGCATCAAACCAGAGTCATGTA | 0276 | ACAGGCCTTCCAATGCCTAAGA | 0614 | chr2 | 179469373 | 179469933 |
| TTN_36#5c | TCCGTCCTTCAGTCAGTATTTCAT | 0277 | TTTCTTAAGGACACCTGTGTGA | 0615 | chr2 | 179486301 | 179486800 |
| TTN_4#1 b | TTAAAAGAATTTTATGCAAAGATGG | 0278 | AAAGTCCAGCTCAGCAATGTTTT | 0616 | chr2 | 179401599 | 179402129 |
| TTN_105c | TTTTGGTCGTTTCAGATTTGTGAG | 0279 | AAGTTGTGCGTAAAGGTCAAAG | 0617 | chr2 | 179559220 | 179559819 |
| TTN_138c | TTGTTACAGACATTGTTAAGATTCGAT | 0280 | GTGTTTGCAGGTAAATTGTAAAAATCC | 0618 | chr2 | 179623645 | 179623970 |
| TTN_161c | TGCAGCTGGCTGTAATGTGAT | 0281 | GAAAAGGGATTTTACATCTTCAAA | 0619 | chr2 | 179656737 | 179657033 |
| TTN_35#1 c | TTTATTTTAATTGATAGGCCTAATATCTG | 0282 | GGTCTACAGAAAGGAGGAGTTGA | 0620 | chr2 | 179482436 | 179483027 |
| TTN_107c | TG CAAATCAGGTTCATAG CA | 0283 | TAGTGAAGCAGTTGGATGGAT | 0621 | chr2 | 179560505 | 179561054 |
| TTN_134#13b | TGCATGCTACAGATCTCACAAATC | 0284 | AAAATAGACAATAACCTAGCTGTCATTC | 0622 | chr2 | 179616858 | 179617497 |
| TTN_116c | GTTGACTGTGGATGCGGAAC | 0285 | AGGCTTATTTTACAAAGGGGGATA | 0623 | chr2 | 179571110 | 179571759 |
| TTN_145c | TTTTAAAACGATAACGATCAAGATT | 0286 | TACTTCTGCAAAGATTTTCCCATT | 0624 | chr2 | 179635874 | 179636270 |
| TTN_165c | GAGTTTCATGGCAGAAATCCAG | 0287 | TTAAAGCACTTCCAGCTTTTCATC | 0625 | chr2 | 179659575 | 179660069 |
| TTN_36#3c | TAAGGTCTTCCTCTGTTGTAAAGG | 0288 | CTTGTCGGTTGCTTTCAGA | 0626 | chr2 | 179485341 | 179485738 |
| TTN_146#1c | AGGAATTTTGGGGGAAATGAATA | 0289 | AGACGAAGGACCTTACAAGCTG | 0627 | chr2 | 179637754 | 179638253 |
| TTN_98b | AGAATTTAACACACTCGAAGATTTTT | 0290 | TGTCCACCCGTCTGCTTTC | 0628 | chr2 | 179553710 | 179554409 |
| TTN_167#1c | ATGATACATGATCACCTTCTAAAATACTTC | 0291 | CCCTCCTCCCGTGTAAGTTTC | 0629 | chr2 | 179663135 | 179663832 |
| TTN_148#c | ACTGTGGCAAGGAGCTATGAT | 0292 | TCTCCCAGCTAAAACTTCAAC | 0630 | chr2 | 179643918 | 179644293 |
| TTN_167#3c | CTTTCTCGTTTCAAAACCTAGTTCC | 0293 | TCTTTTAAAATGGGTCATTGTGC | 0631 | chr2 | 179664150 | 179664694 |
| TTN_45c | TTAGAACTTGGCGTCCTATCTT | 0294 | AAATTTGTATCTGAAACACTTCTCCT | 0632 | chr2 | 179499013 | 179499651 |
| TTN_129#4c | GACTGGACTGGGCTTCTTAAT | 0295 | GGTTGGCAAATTTTATTTCCACTTA | 0633 | chr2 | 179594638 | 179595232 |
| TTN_89#2b | GACAGCTTCTTCAGCACTTCAAA | 0296 | CCTACTTCAATAGGCTATGGCTATACT | 0634 | chr2 | 179546161 | 179546592 |
| TTN_46b | TAGATCCTGAATATTGGATGTGGT | 0297 | TCCTGAAATTTACTAAGGAAGCTATGTA | 0635 | chr2 | 179499827 | 179500520 |
| TTN_149c | CCGAGCTCATCACTTGAA | 0298 | TTATCAACTTTCCCCAGTGTAGAG | 0636 | chr2 | 179644635 | 179645031 |
| TTN_168c | TGGCCCCATTTAGACACAAAC | 0299 | TTTAAAAATACCTTGTAGGGAGCAC | 0637 | chr2 | 179665057 | 179665474 |

TABLE 3-continued

TTN and Control amplimer PCR primers*

| Amplimer | Forward primer | SEQ ID NO | Reverse primer | SEQ ID NO | Chr | Start | End |
|---|---|---|---|---|---|---|---|
| TTN_55c | TCATTTCAGATGGCTGGATAGA | 0300 | TGTTTTATGTTCGGATACTGGTATTACG | 0638 | chr2 | 179510581 | 179510928 |
| TTN_134#14c | AG CTAG GTTATTGTCTATTTTCAATGTAAT | 0301 | AAAAATGTTTTAAATCTTTCTGTCAAC | 0639 | chr2 | 179617477 | 17961813 |
| TTN_32#1b | TCCCAAGGAATACTAAAGAGTAAACA | 0302 | AGTTGCTGCAGAAAACATGTATGG | 0640 | chr2 | 179478404 | 17947852 |
| TTN_95b | AGACAGTTATGCAAATGTGAAGGTATTATT | 0303 | AGGGGTTTGGCAAGGGTTA | 0641 | chr2 | 179549902 | 17955046 |
| TTN_15#2c | TGAGCCCCATCATCTGC | 0304 | GGTCTCCAGACCTCTACTCTATACTCAT | 0642 | chr2 | 179446841 | 17944788 |
| TTN_171c | AACCAGCTTAAATTGATCTTACATTCC | 0305 | TTCACTTAATATTCTAAAAGTTGAGGTC | 0643 | chr2 | 179671302 | 17967196 |
| TTN_59c | TTTCTGTGCAATATGGTTTTAACATAAAT | 0306 | TGCTGCTCCAATAAATCAGGTTT | 0644 | chr2 | 179513858 | 17951447 |
| TTN_142e | GGTTAGAAAATGTAAAGGGAAACATT | 0307 | TGAATTATATCTCAATAAAGCTGTTAAAAA | 0645 | chr2 | 179632393 | 17963241 |
| TTN_21#8b | TCATGGGCAGCATTACGAA | 0308 | ATGAAGAGTGGAAGAGCCAATC | 0646 | chr2 | 179457183 | 17945675 |
| TTN_62-63 | GGAAGGAAGAAGAACAAAGCTTAAAT | 0309 | TCCAATTCCTCTGCTGTATATTTTG | 0647 | chr2 | 179515402 | 17951521 |
| TTN_150c | CAGCAAACGGACAGCACT | 0310 | TCACAGATAAGTCCAATTATTTTACCC | 0648 | chr2 | 179645773 | 17964068 |
| TTN_172c | TCCAGAGCCAGAGATCAATAA | 0311 | CAACACAGTTATTCTTTAAATACAGTTCTA | 0649 | chr2 | 179671876 | 17967275 |
| TTN_82c | AATATGTTGATTTCCTGGGGTAAA | 0312 | TCATCTTGTGTATGTGCCTTG | 0650 | chr2 | 179539659 | 17953998 |
| TTN_152c | G CACAGAAACCATATTGTG GAAAAG | 0313 | GCATAAGTTCAAACTCTACATTTGTT | 0651 | chr2 | 179647451 | 17964781 |
| TTN_6b | CAAAAAGGTGAATTTTCCCACATA | 0314 | CCAACCAAAACCTAAGGAAAACAC | 0652 | chr2 | 179405941 | 17940402 |
| TTN_67-69 | CCAGAGCACAAGAGATAGATCA | 0315 | TGATGTGCTGCTGGAAAA | 0653 | chr2 | 179522175 | 17952456 |
| TTN_151c | CTACTCTAGGCTTCATGCACGTAT | 0316 | TCAGTGCTAAGCAGGGGTCACT | 0654 | chr2 | 179646873 | 17964791 |
| TTN_173c | CACTTGTGGGCAGTCATACAAAA | 0317 | TGGATTCTGGAGAATGTAGGTAG | 0655 | chr2 | 179672451 | 17967281 |
| TTN_85#2c | ATGAAGAAGCTTATGAAAGGCAAAT | 0318 | TTTCATATCTATTGCTCTAAGACATTTT | 0656 | chr2 | 179542703 | 17954302 |
| TTN_26#1c | TGTGAACTATTATTGAACACCTAGGAAG | 0319 | AAGCCTGGACCAAAGTCAA | 0657 | chr2 | 179465509 | 17946653 |
| TTN_8#9b | GAGCACAACCGTCATTGAGTG | 0320 | TGGCCTTGTGATATGGCACTAC | 0658 | chr2 | 179414498 | 17941592 |
| TTN_71 | CCAGAGCAGAAGAGATACATCA | 0321 | TGGGTGGGCGATAGAAA | 0659 | chr2 | 179528304 | 17952952 |
| TTN_156c | TGATTCCCTAAGGGTAAGATTGT | 0322 | TTGTTTCATTCTTTGCTTTAACTCTCC | 0660 | chr2 | 179651422 | 17965624 |
| TTN_174c | ATG CTTAAATCATCCATAAG GTTCC | 0323 | ACAAGACAATTTTCCTCCCTCTAAG | 0661 | chr2 | 179672888 | 17967325 |
| TTN_86c | TGTAATGGGGAAATTTGTATGTGAG | 0324 | CTTAATCTTTTGAAACTATGCTTGG | 0662 | chr2 | 179543061 | 17954301 |
| TTN_22c | GAATGAAATGTACGGCATTTATACACA | 0325 | TCAAAACAACATTTTTGTCTCCTTT | 0663 | chr2 | 179460134 | 17946033 |
| TTN_8#4b | GCTTCGCTGGCCTTGCTA | 0326 | GCGCACTCAAATTAAAGTCACTCAT | 0664 | chr2 | 179411762 | 17941261 |
| TTN_147#6c | TCCCCAGAATCACTGGGTGT | 0327 | TGTTTTGCTGAGTTTTCTTTATGCC | 0665 | chr2 | 179642211 | 17964259 |
| TTN_157c | GGAGGATGGACTGAATCTAACCA | 0328 | AAAATCTGCTGAACCAGCCACA | 0666 | chr2 | 179652753 | 17965297 |
| TTN_25#2c | CTGGCTCTTCCCAGTTGACAG | 0329 | TGATGGTGGGTCTAAGATTACAAAC | 0667 | chr2 | 179463712 | 17946487 |
| TTN_76c | AAAAGACAAACATAGTGAATTTAAGGA | 0330 | TCATCTTGTTAGATGCCCCTTC | 0668 | chr2 | 179534030 | 17953491 |
| TTN_119#2c | ATTTCTCCCTAAGTTCATATTTGATT | 0331 | ATTGCATATATACGTGCGTTTG | 0669 | chr2 | 179575719 | 17957617 |
| TTN_3#12b | TAGCTCTGACTTGGTAAACTGTGG | 0332 | CCAATTTCATCTTTCTGGAATAGC | 0670 | chr2 | 179400757 | 17940135 |
| MYBPC3_8 | GGGCTGGGGATGATTTG | 0333 | GGGACACTAGCCAGATTGG | 0671 | chr1 | 47369117 | 47369331 |
| MYL2_2 | CACCCAGAGTAGGGGCCTGACCTA | 0334 | TTCAGGCCGAATTTGGGATTGTTT | 0672 | chr12 | 111356770 | 111357073 |
| MYH7_12 | GGGAGTCTCAGAACCCACAG | 0335 | TGAGCAGACATGGCCCTCC | 0673 | chr14 | 23898925 | 23899240 |
| GLA_2 | GTGAAATCCCAAGGTGCCTA | 0336 | AGAAGTGCTTACAGTCCTCTGAA | 0674 | chrX | 100658747 | 100659058 |

TABLE 3 -continued

TTN and Control amplimer PCR primers*

| Amplimer | Forward primer | SEQ ID NO | Reverse primer | SEQ ID NO | Chr | Start | End |
|---|---|---|---|---|---|---|---|
| LAM P2_4 | GGGTAGGGCAGGCAGAGA | 0337 | CAGATAATGACTTCAATGAAAGCTA | 0675 | chrX | 11958274 | 11958387 |
| G6PDel1 | TAGCTCCACCCTCACCCCG | 0338 | GTGGCCTTTGCCCTCCCT | 0676 | chrX | 153760338 | 153760557 |
| G6PDel0 | GGTCCAGCTCCGACTCCT | 0339 | GGTGCCCTTCATCCTGCG | 0677 | chrX | 153760804 | 153761016 |
| SRYc | TGGCTGTAGCGGTCCCGT | 0340 | TCGTCGGAAGGCGAAGAT | 0678 | chrY | 2655045 | 2655252 |
| SRYb | ATCCTGGACGTTGCCTTTACTG | 0341 | AAATAAGTTTCGAACTCTGGCACCT | 0679 | chrY | 2655470 | 2655702 |

*Positions correspond to hg19. MYBPC3, MYL2, MYH7, GLA, LAMP, G6PD, and SRY primers were used as controls for CNV analyses.

TABLE 4

Genomic library adaptor oligonucleotides

| Name | Sequence | SEQ ID NO |
|---|---|---|
| Solexa_PE_Fh_AACT | ACACTCTTTCCCTACACGACGCTCTTCCGATCTAAC*T | 0680 |
| Solexa_5'AACT | /5Phos/GTTAGATCGGAAGAGCGGTTCAGCAGGAATGCCGAG | 0681 |
| Solexa_PE_Fh_AGGT | ACACTCTTTCCCTACACGACGCTCTTCCGATCTAGG*T | 0682 |
| Solexa_5'AGGT | /5Phos/CCTAGATCGGAAGAGCGGTTCAGCAGGAATGCCGAG | 0683 |
| Solexa_PE_Fh_ATGT | ACACTCTTTCCCTACACGACGCTCTTCCGATCTATG*T | 0684 |
| Solexa_5'ATGT | /5Phos/CATAGATCGGAAGAGCGGTTCAGCAGGAATGCCGAG | 0685 |
| Solexa_PE_Fh_CACT | ACACTCTTTCCCTACACGACGCTCTTCCGATCTCAC*T | 0686 |
| Solexa_5'CACT | /5Phos/GTGAGATCGGAAGAGCGGTTCAGCAGGAATGCCGAG | 0687 |
| Solexa_PE_Fh_CGAT | ACACTCTTTCCCTACACGACGCTCTTCCGATCTCGA*T | 0688 |
| Solexa_5'CGAT | /5Phos/TCGAGATCGGAAGAGCGGTTCAGCAGGAATGCCGAG | 0689 |
| Solexa_PE_Fh_GGAT | ACACTCTTTCCCTACACGACGCTCTTCCGATCTGGA*T | 0690 |
| Solexa_5'GGAT | /5Phos/TCCAGATCGGAAGAGCGGTTCAGCAGGAATGCCGAG | 0691 |
| Solexa_PE_Fh_GTCT | ACACTCTTTCCCTACACGACGCTCTTCCGATCTGTC*T | 0692 |
| Solexa_5'GTCT | /5Phos/GACAGATCGGAAGAGCGGTTCAGCAGGAATGCCGAG | 0693 |
| Solexa_PE_Fh_TCGT | ACACTCTTTCCCTACACGACGCTCTTCCGATCTTCG*T | 0694 |
| Solexa_5'TCGT | /5Phos/CGAAGATCGGAAGAGCGGTTCAGCAGGAATGCCGAG | 0695 |
| Solexa_PE_Fh_TGAT | ACACTCTTTCCCTACACGACGCTCTTCCGATCTTGA*T | 0696 |
| Solexa_5'TGAT | /5Phos/TCAAGATCGGAAGAGCGGTTCAGCAGGAATGCCGAG | 0697 |
| Solexa_PE_Fh_TTCT | ACACTCTTTCCCTACACGACGCTCTTCCGATCTTTC*T | 0698 |
| Solexa_5'TTCT | /5Phos/GAAAGATCGGAAGAGCGGTTCAGCAGGAATGCCGAG | 0699 |
| Solexa_PE_5ACGT | /5Phos/CGTAGATCGGAAGAGCGGTTCAGCAGGAATGCCGAG | 0700 |
| Solexa_Fh_ACGT | ACACTCTTTCCCTACACGACGCTCTTCCGATCTACG*T | 0701 |
| Solexa_PE_5AGCT | /5Phos/GCTAGATCGGAAGAGCGGTTCAGCAGGAATGCCGAG | 0702 |
| Solexa_Fh_AGCT | ACACTCTTTCCCTACACGACGCTCTTCCGATCTAGC*T | 0703 |
| Solexa_PE_5'TGGT | /5Phos/CCAAGATCGGAAGAGCGGTTCAGCAGGAATGCCGAG | 0704 |
| Solexa_Fh_TGGT | ACACTCTTTCCCTACACGACGCTCTTCCGATCTTGG*T | 0705 |

TABLE 4 -continued

Genomic library adaptor oligonucleotides

| Name | Sequence | SEQ ID NO |
|---|---|---|
| Solexa_PE_5'TCCT | /5Phos/GGAAGATCGGAAGAGCGGTTCAGCAGGAATGCCGAG | 0706 |
| Solexa_Fh_TCCT | ACACTCTTTCCCTACACGACGCTCTTCCGATCTTCC*T | 0707 |
| Solexa_PE_5'GACT | /5Phos/GTCAGATCGGAAGAGCGGTTCAGCAGGAATGCCGAG | 0708 |
| Solexa_Fh_GACT | ACACTCTTTCCCTACACGACGCTCTTCCGATCTGAC*T | 0709 |
| Solexa_PE_5'CGTT | /5Phos/ACGAGATCGGAAGAGCGGTTCAGCAGGAATGCCGAG | 0710 |
| Solexa_Fh_CGTT | ACACTCTTTCCCTACACGACGCTCTTCCGATCTCGT*T | 0711 |
| Solexa_PE_5'GTGT | /5Phos/CACAGATCGGAAGAGCGGTTCAGCAGGAATGCCGAG | 0712 |
| Solexa_Fh_GTGT | ACACTCTTTCCCTACACGACGCTCTTCCGATCTGTG*T | 0713 |
| Solexa_PE_5'CTCT | /5Phos/GAGAGATCGGAAGAGCGGTTCAGCAGGAATGCCGAG | 0714 |
| Solexa_Fh_CTCT | ACACTCTTTCCCTACACGACGCTCTTCCGATCTCTC*T | 0715 |
| Solexa_PE_5'CAGT | /5Phos/CTGAGATCGGAAGAGCGGTTCAGCAGGAATGCCGAG | 0716 |
| Solexa_Fh_CAGT | ACACTCTTTCCCTACACGACGCTCTTCCGATCTCAG*T | 0717 |
| Solexa_PE_5'GCAT | /5Phos/TGCAGATCGGAAGAGCGGTTCAGCAGGAATGCCGAG | 0718 |
| Solexa_Fh_GCAT | ACACTCTTTCCCTACACGACGCTCTTCCGATCTGCA*T | 0719 |

*phosphorothioate linkage;
/5Phos/ = 5' phosphate

TABLE 5

Summary of cohort characteristics*

|  | DCM-A | DCM-B | DCM-C | HCM | Control |
|---|---|---|---|---|---|
| Subjects, no. | 92 | 71 | 149 | 31 | 249 |
| Women, no. (%) | 28 (30) | 16 (23) | 60 (40) | NA | NA |
| Age, yr* | 37.2 ± 14.0 | 40.6 ± 12.7 | 39.4 ± 12.5 | NA | NA |
| LVEF (%)* | 29.4 ± 12.2 | 24.8 ± 11.5 | 31.2 ± 11.5 | NA | NA |
| Sequencing Methodology^ | Next-gen | Next-gen | Dideoxy | Next-gen | Next-gen |
| Mutation Positive, no. (%) | 37 (40) | 17 (24) | 13 (9) | 3 | 7 |
| Family History, no. (%) |  |  |  | NA | NA |
| Yes | 78 (89) | 9 (21) | 102 (68) |  |  |
| No | 10 (11) | 30 (70) | 47 (32) |  |  |
| NA | 4 | 29 | 0 |  |  |
| Mutation Positive |  |  |  |  |  |
| Family History, no. (%) |  |  |  | NA | NA |
| Yes | 33 (88) | 3 (21) | 11 (85) |  |  |
| No | 3 (12) | 11 (79) | 2 (15) |  |  |
| NA |  | 1 | 3 |  |  |

No., number;

*Values are means ± SD.

^ Sequencing methods were Next-gen, filter-based hybridization capture of TTN and next-generation sequencing or Dideoxy, conventional Sanger dideoxy sequencing.

Age and left ventricular ejection fraction (LVEF) are taken at the time of initial diagnosis of DCM.

Percent of subjects with family history excludes subjects in whom family history was not available.

Across all DCM cohorts, TTN truncating mutations were found in 25% of subjects with and 18% of subjects without a family history of DCM (P = 0.3).

TABLE 6

Sequencing data for TTN truncating mutations

| Chr position | Ref base | Var base | Nucleotide change | Quality | Filter | Allele balance | # Reads Major allele | # Reads Minor allele | Total | Subject | Cohort |
|---|---|---|---|---|---|---|---|---|---|---|---|
| 179659280 | TA | T | c.1246 − 3delT | 23585.55 | PASS | 0.14 | 1146 | 6989 | 8135 | pv-75 | control |
| 179647331 | T | A | c.3101 − 2A > T | 7728.48 | FDRtranche10.00 to 50.00+ | 0.58 | 348 | 250 | 598 | N-50 | control |
| 179604949 | CT | C | c.12059delA | 10405.56 | PASS | 0.43 | 1155 | 1551 | 2706 | pv-1 | control |
| 179604264 | G | A | c.12745C > T | 1962.07 | PASS | 0.57 | 136 | 103 | 239 | HFA-42 | A |
| 179591957 | TC | T | c.19183delG | 2609.57 | PASS | 0.54 | 120 | 104 | 224 | HFA-9 | A |
| 179583071 | ACAGATATCTTGAC (SEQ ID NO: 724) | A | c.23798_23810delGTCAAGATATCTG (SEQ ID NO: 723) | 1797.98 | PASS; StrandBias | 0.22 | 124 | 451 | 575 | PA-1 | HCM |
| 179558736 | C | T | c.30476 − 1G > A | 2380.12 | FDRtranche10.00 to 50.00+; PASS | 0.58 | 155 | 113 | 268 | D13KD-1 | A |
| 179535816 | C | A | c.34186 + 1G > T | 833.79 | PASS | 0.49 | 38 | 39 | 77 | SS-333 | HCM |
| 179516991 | C | A | c.34690G > T | 1122.33 | PASS | 0.10 | 109 | 955 | 1064 | 12s-C11 | control |
| 179506963 | C | T | c.35635 + 1G > A | 7327.23 | PASS | 0.54 | 65 | 55 | 120 | HFA-26 | A |
| 179506963 | C | T | c.35635 + 1G > A | 7327.23 | PASS | 0.55 | 263 | 217 | 480 | HFA-41 | A |
| 179506964 | C | G | c.35635G > C | 6450.31 | PASS | 0.43 | 55 | 75 | 131 | UK-B12 | B |
| 179498055 | T | C | c.38024 − 2A > G | 1440.31 | FDRtranche10.00 to 50.00+ | 0.58 | 288 | 207 | 495 | MIY-11 | A |
| 179497076 | T | TA | c.38621_38622insA | 2339.05 | PASS | 0.20 | 145 | 595 | 740 | MDT-11 | A |
| 179485012 | G | T | c.41313C > A | 12126.6 | PASS | 0.52 | 421 | 383 | 804 | UK-H11 | B |
| 179478864 | CT | C | c.44336delA | 4754.46 | PASS | 0.56 | 240 | 187 | 427 | HFA-68 | A |
| 179477885 | TA | T | c.44725 + 2delT | 5928.55 | PASS | 0.48 | 90 | 98 | 188 | MDD-22 | A |
| 179477885 | TA | T | c.44725 + 2delT | 5928.55 | PASS | 0.48 | 90 | 98 | 188 | MIV-14 | A |
| 179477004 | TA | T | c.45322delT | 4088.96 | PASS | 0.52 | 178 | 166 | 344 | UK-G1 | B |
| 179472127 | C | A | c.48364 + 1G > T | 3132.58 | FDRtranche10.00 to 50.00+; PASS | 0.57 | 215 | 159 | 374 | HFA-71 | A |
| 179471841 | C | A | c.48565G > T | 17194.16 | PASS | 0.48 | 479 | 516 | 995 | UK-A3 | B |
| 179467006 | T | C | c.50197 + 3A > G | 4964.76 | PASS | 0.55 | 226 | 183 | 409 | 12s-G11 | control |
| 179458075 | AG | A | c.53935delC | 4133.57 | PASS | 0.51 | 179 | 172 | 351 | HFA-63 | A |
| 179457392 | A | T | c.54422 − 5T > A | 6168.22 | PASS | 0.54 | 215 | 186 | 401 | UK-B1 | B |
| 179457005 | C | T | c.54704 − 1G > A | 1273.14 | PASS | 0.49 | 56 | 59 | 115 | UK-B12 | B |
| 179456704 | C | T | c.55003 + 1G > A | 7835.09 | PASS | 0.53 | 310 | 276 | 586 | MGR-11 | A |
| 179455162 | A | T | c.56367T > A | 5790.41 | PASS | 0.58 | 228 | 167 | 395 | MEH-11 | A |
| 179454957 | G | A | c.56572C > T | 8250.03 | PASS | 0.52 | 269 | 253 | 522 | MDJ-21 | A |
| 179454576 | G | A | c.56953G > A | 5819.28 | PASS | 0.52 | 197 | 184 | 381 | MEW-11 | A |
| 179452435 | G | A | c.58678C > T | 3233.06 | PASS | 0.58 | 198 | 146 | 344 | MAO-92 | A |
| 179447207 | TG | T | c.60147delC | 1144.41 | StrandBias | 0.23 | 165 | 552 | 717 | SS-201 | HCM |
| 179444661 | C | T | c.62425 + 5G > A | 9756.67 | FDRtranche10.00 to 50.00+; PASS | 0.24 | 8 | 25 | 33 | MAM-12 | A |
| 179444429 | G | A | c.62572C > T | 18928.38 | PASS | 0.57 | 572 | 428 | 1000 | UK-A10 | B |
| 179443339 | T | C | c.63405A > G | 1427.03 | PASS | 0.55 | 224 | 187 | 411 | MIS-11 | A |
| 179442324 | C | G | c.63901 + 5G > C | 7488.06 | FDRtranche10.00 to 50.00+ | 0.55 | 343 | 286 | 629 | MCL-15 | A |
| 179441649 | C | T | c.64489 + 1G > A | 6822.3 | PASS | 0.52 | 255 | 234 | 489 | UK-B2 | B |
| 179441015 | CT | C | c.64920delA | 5378.99 | PASS | 0.66 | 395 | 201 | 596 | UK-H2 | B |
| 179440067 | CT | C | c.65867delA | 2395.82 | PASS | 0.13 | 117 | 798 | 915 | UK-C8 | B |
| 179438874 | ATATGC | A | c.67057_67063delGCATATGinsTA | 4467.51 | PASS | 0.23 | 165 | 559 | 724 | MHG-23 | A |
| 179434160 | CAA | C | c.71774_71775delTT | 7059.09 | PASS | 0.54 | 306 | 262 | 568 | A-15 | control |
| 179433758 | G | GT | c.72178_72179insT | 4981.24 | PASS | 0.55 | 244 | 197 | 441 | HFA-57 | A |
| 179433213 | G | GGTTTATCTATCT | c.72723_72739delinsAGA | 945.03 | PASS | 0.33 | 125 | 254 | 379 | SS287-15 | A |
| 179428871 | G | A | c.77065C > T | 21554.16 | FDRtranche10.00 to 50.00+; PASS | 0.61 | 188 | 119 | 307 | MID-1 | A |
| 179428871 | G | A | c.77065C > T | 21554.16 | FDRtranche10.00 to 50.00+; PASS | 0.61 | 188 | 119 | 307 | SS725 | A |
| 179425091 | G | A | c.80845C > T | 1841.18 | PASS | 0.14 | 127 | 784 | 911 | MGW-11 | A |
| 179424496 | C | T | c.81440G > A | 1670.2 | PASS | 0.14 | 148 | 898 | 1046 | MIP-13 | A |
| 179424398 | CAG | C | c.81536_81537delCT | 6212.74 | StrandBias | 0.57 | 283 | 214 | 497 | UK-C6 | B |
| 179424036 | A | T | c.81898 + 2T > A | 10097.32 | PASS | 0.47 | 266 | 300 | 566 | MIA-1 | A |
| 179422457 | G | T | c.82701C > A | 2923.47 | PASS | 0.59 | 219 | 153 | 372 | UK-B6 | B |
| 179417723 | ATAAT | A | c.84977_84980delATTA | 8795.62 | PASS | 0.62 | 230 | 142 | 372 | UK-E12 | B |
| 179413187 | G | A | c.88242C > T | 2808.37 | PASS | 0.54 | 150 | 126 | 276 | UK-C10 | B |
| 179412902 | C | A | c.88528G > T | 1639 | FDRtranche10.00 to 50.00+; PASS | 0.53 | 87 | 76 | 163 | MBG-121 | A |
| 179412245 | CTTTAA | C | c.89180_89184delAAATT | 10083.39 | PASS | 0.54 | 140 | 117 | 257 | HFA-46 | A |
| 179410799 | G | A | c.90241C > T | 1584.39 | PASS | 0.12 | 107 | 782 | 889 | MHQ-12 | A |
| 179410544 | T | TGGG | c.90493 + 2insCCT | 41982.72 | PASS | 0.58 | 862 | 621 | 1483 | SS723 | A |
| 179408239 | G | GT | c.91537_91538insA | 3613 | PASS | 0.62 | 220 | 136 | 356 | UK-E4 | B |

TABLE 6-continued

Sequencing data for TTN truncating mutations

| Chr position | Ref base | Var base | Nucleotide change | Quality | Filter | Allele balance | # Reads Major allele | # Reads Minor allele | Total | Subject | Cohort |
|---|---|---|---|---|---|---|---|---|---|---|---|
| 179406990 | C | G | c.92569 + 1G > C | 8827.13 | FDRtranche10.00 to 50.00+; PASS | 0.51 | 180 | 173 | 353 | HFA-83 | A |
| 179406990 | C | G | c.92569 + 1G > C | 8827.13 | FDRtranche10.00 to 50.00+; PASS | 0.51 | 289 | 274 | 563 | HFA-66 | A |
| 179404491 | CCT | C | c.93376_93377delAG | 12491.23 | PASS | 0.61 | 562 | 361 | 923 | UK-G7 | B |
| 179404286 | G | A | c.93583C > T | 8470.72 | PASS | 0.55 | 364 | 299 | 663 | UK-G9 | B |
| 179403522 | T | A | c.94111A > T | 7746.65 | PASS | 0.50 | 250 | 250 | 500 | MHX-11 | A |
| 179402067 | A | G | c.94942 + 2T > C | 7331.01 | PASS | 0.50 | 269 | 265 | 534 | pv-35 | control |
| 179401029 | G | T | c.95522C > A | 2296.56 | PASS | 0.58 | 158 | 115 | 273 | UK-C9 | B |

TABLE 7

Numbers of TTN missense variants* and truncating mutations in cohorts.

| Cohort | Cohort size (no.) | Missense variants | Avg./subject^ | Truncating mutations | Avg./subject^ |
|---|---|---|---|---|---|
| DCM-A | 92 | 117 | 1.27 | 37 | 0.40 |
| DCM-B | 71 | 103 | 1.45 | 17 | 0.24 |
| DCM-C | 149 | 136 | 0.91 | 13 | 0.087 |
| HCM | 231 | 263 | 1.14 | 3 | 0.013 |
| Control | 249 | 332 | 1.33 | 7 | 0.027 |

*Missense variants and truncating mutations with a minor allele frequency less than 0.01.
^ Average number of missense variants or truncating mutations per subject.

TABLE 8

TTN nonsense and frameshift mutations*

| Chr 2 Position | Nucleotide | Amino Acid | Pedigree | ID | Diagnosis |
|---|---|---|---|---|---|
| 179640342 | c.6247delG | p.Arg2083fs | TSSDC011 | 450 | DCM |
| 179604949 | c.12059delA | p.Lys4020fs | pv | 1 | Control |
| 179604264 | c.12745C > T | p.Gln4249X | HFA | 42 | DCM |
| 179591957 | c.19183delG | p.Ser6395fs | HFA | 9 | DCM |
| 179583071 | c.23798_23810delGTCAAGATATCTG (SEQ ID NO: 723) | p.Gly7933fs | PA | 1 | HCM |
| 179497076 | c.38621_38622insA | p.Ala12873fs | MDT | 11 | DCM |
| 179485012 | c.41313C > A | p.Cys13771X | UK | H11 | DCM |
| 179478864 | c.44336delA | p.Glu14779fs | HFA | 68 | DCM |
| 179477004 | c.45322delT | p.Phe15108fs | UK | G1 | DCM |
| 179471841 | c.48565G > A | p.Gly16189X | UK | A3 | DCM |
| 179469903 | c.49077G > A | p.Trp16359X | DNFDC144 | 05-0444 | DCM |
| 179463630 | c.51883G > A | p.Arg17295X | DNFDC116 | 04-1545 | DCM |
| 179462477 | c.52408C > T | p.Arg17470X | TSFDC050 | 115 | DCM |
| 179459153 | c.53145_53146insG | p.Glu17715fs | TSFDC017 | 253-2 | DCM |
| 179458849 | c.53347G > T | p.Glu17783X | DNFDC103 | 03-0941 | DCM |
| 179458075 | c.53935delC | p.Glu17978fs | HFA | 63 | DCM |
| 179455162 | c.56367T > A | p.Cys18789X | MEH | 11 | DCM |
| 179454957 | c.56572C > T | p.Arg18858X | MDJ | 21 | DCM |
| 179454575 | c.56953C > T | p.Arg18985X | DNFDC142 | 05-0569 | DCM |
|  |  |  | MEW | 11 | DCM |
| 179452435 | c.58678C > T | p.Arg19560X | MAO | 92 | DCM |
| 179449211 | c.60147delC | p.Pro20049fs | SS | 201 | HCM |
| 179444429 | c.62572C > T | p.Arg20858X | UK | A10 | DCM |
| 179441015 | c.64925delT | p.Lys21640fs | UK | H2 | DCM |
| 179440067 | c.65867delA | p.Glu21956fs | UK | C8 | DCM |
| 179438874 | c.67057_67063delGCATATGinsTA | p.Ala22353fs | MHG | 23 | DCM |
| 17943819 | c.67745delT | p.Pro22582fs | MEK | 111 | DCM |
| 179434160 | c.71774_71775delTT | p.L23925fs | A | 015 | Control |
| 179433758 | c.72178_72179insT | p.Gln24059fs | HFA | 57 | DCM |
| 179433213 | c.72723_72739delinsAGA | p.Ser24241fs | SS | 287-15 | DCM |
| 179428871 | c.77065C > T | p.Gln25689X | MID | 1 | DCM |
|  |  |  | SS | 725 | DCM |
| 179426039 | c.79896G > A | p.Trp26632X | DNFDC088 | 02-1900 | DCM |
| 179425091 | c.80845C > T | p.Arg26949X | MGW | 11 | DCM |
| 179424889 | c.81046A > T | p.Lys27016X | DNFDC081 | 02-1564 | DCM |
| 179424496 | c.81440G > A | p.Trp27147X | MIP | 13 | DCM |
| 179424398 | c.81536_81537delCT | p.Ser27179fs | UK | C6 | DCM |
| 179422457 | c.82701C > A | p.Tyr27567X | UK | B6 | DCM |

TABLE 8-continued

TTN nonsense and frameshift mutations*

| Chr 2 Position | Nucleotide | Amino Acid | Pedigree | ID | Diagnosis |
|---|---|---|---|---|---|
| 179417723 | c.84977_84980delATTA | p.Tyr28326fs | UK | E12 | DCM |
| 179413476 | c.87953G > A | p.Trp29318X | TSSDC019 | 268 | DCM |
| 179413187 | c.88242C > T | p.Arg29415X | UK | C10 | DCM |
|  |  |  | TSFDC002 | 23 | DCM |
| 179412902 | c.88528G > T | p.Glu29510X | MBG | 121 | DCM |
| 179412245 | c.89180_89184delTTAAA | p.Thr29725fs | HFA | 46 | DCM |
| 179410799 | c.90241C > T | p.Gln30081X | MHQ | 12 | DCM |
| 179408989 | c.91043delA | p.Asn30348fs | TSFDC033 | 434 | DCM |
| 179408239 | c.91537_91538insA | p.Thr30513fs | UK | E4 | DCM |
| 179404491 | c.93376_93377delAG | p.Arg31126fs | UK | G7 | DCM |
| 179404286 | c.93583C > T | p.Arg31195X | UK | G9 | DCM |
| 179403522 | c.94111A > T | p.Lys31371X | MHX | 11 | DCM |
| 179401029 | c.95522C > A | p.Ser31841X | UK | C9 | DCM |

*Mutations are annotated using Human Genome Variation Society guidelines: available on the world wide web at http://www.hgvs.org/mutnomen/.

TABLE 9

TTN splicing mutations

| Chr 2 Position | Nucleotide | Position in splice site 5' | Position in splice site 3' | Splicing score change | Amino Acid | Pedigree | ID | Diagnosis |
|---|---|---|---|---|---|---|---|---|
| 179659280 | c.1246 − 3delT | — | −3 | −2.2 | p.Val416 | pv | 75 | Control |
| 179647331 | c.3101 − 2A > T | — | −2 | −8.37 | p.Val1034 | N | 050 | Control |
| 179558736 | c.30476 − 1G > A | — | −1 | −8.75 | p.Gly10159 | D13KD | 1 | DCM |
| 179535816 | c.34186 + 1G > T | +1 | — | −8.5 | p.Val11396 | SS | 333 | HCM |
| 179516991 | c.34690G > T | +1 | — | −11.03 | p.Val11564Phe | 12s | C11 | Control |
| 179506964 | c.35635G > C | −1 | — | −14.19 | p.Val11879 | UK | B12 | DCM |
| 179506779 | c.35635 + 1G > A | +1 | — | −8.18 | p.Val11879 | HFA | 26 | DCM |
|  |  |  |  |  |  | HFA | 41 | DCM |
| 179498055 | c.38024 − 2A > G | — | −2 | −7.95 | p.Ala12675 | MIY | 11 | DCM |
| 179477885 | c.44725 + 2delT | +2 | — | −12.92 | p.Asp14909 | MDD | 22 | DCM |
|  |  |  |  |  |  | MIV | 14 | DCM |
| 179472127 | c.48364 + 1G > T | +1 | — | −8.5 | p.Asp16122 | HFA | 71 | DCM |
| 179467006 | c.50197 + 3A > G | +3 | — | −5.04 | p.Glu16733 | 12s | G11 | Control |
| 179466858 | c.50346 + 3A > G | +3 | — | −3.42 | p.Lys16782 | TSFDC023 | 300 | DCM |
| 179457392 | c.54422 − 5T > A | — | −5 | −2.34 | p.Glu18141 | UK | B1 | DCM |
| 179457005 | c.54704 − 1G > A | — | −1 | −8.75 | p.Asp18235 | UK | B12 | DCM |
| 179456704 | c.55003 + 1G > A | +1 | — | −8.18 | p.His18335 | MGR | 11 | DCM |
| 179444661 | c.62425 + 5G > A | +5 | — | −12.17 | p.Gln20809 | MAM | 12 | DCM |
| 179443339 | c.63405A > G | −2 | — | −2.67 | p.Thr21135 | MIS | 11 | DCM |
| 179442324 | c.63901 + 5G > C | +5 | — | −5.38 | p.Tyr21301 | MCL | 15 | DCM |
| 179441649 | c.64489 + 1G > A | +1 | — | −8.18 | p.Gly21497 | UK | B2 | DCM |
| 179424036 | c.81898 + 2T > A | +2 | — | −8.18 | p.Glu27300 | MIA | 1 | DCM |
| 179410544 | c.90493 + 2insCCT | +2 | — | −32.13 | p.Thr30165 | SS | 723 | DCM |
| 179406779 | c.92569 + 1G > C | +1 | — | −8.27 | p.Arg30857 | HFA | 66 | DCM |
|  |  |  |  |  |  | HFA | 83 | DCM |
| 179402067 | c.94942 + 2T > C | +2 | — | −7.75 | p.Asp31648 | pv | 35 | Control |

*Mutations are annotated using Human Genome Variation Society guidelines: available on the world wide web at http://www.hgvs.org/mutnomen/. Amino acid indicated is the residue juxtaposed to the aberrant splice signal.

TABLE 10

CNV validation primers

| Name | Sequence | SEQ ID NO |
|---|---|---|
| TTN_37_intF1 | TGAGGAGCTGTAAGAGAATGTCATCAGA | 720 |
| TTN_i21_R1 | AGTGCTGGCATTACCACTCCTAGTT | 721 |

TABLE 11

Clinical characteristics of DCM-A probands

| Subject | Sex | BSA (m2) | Current age (yr) or death† | Age of Dx (yr) | Family Hx | LVEF (%)‡ | FS (%)‡ | LVEDD (mm)‡ | NYHA class¶ | Age at VAD, Tx, Death (yr)^ | Comments☐ | Gene | Mutation(s)✕ |
|---|---|---|---|---|---|---|---|---|---|---|---|---|---|
| HFA-42 | M | 1.84 | 66 | 54 | No | 47.5 | 27.9 | 61 | 4 | | CHF, Embolic CVA, ICD | TTN | p.Gln4249X |
| HFA-9 | M | 1.89 | 55 | 42 | Yes | 15 | 15.5 | 84 | 3 | | CHF, ICD(50) NSVT | TTN | p.Ser6394fs |
| D13KD-1 | F | 1.99 | 51 | 39 | Yes | 15 | 24.3 | 70 | 4 | | Nl Cors | TTN | p.Gly10159 |
| MIY-11 | M | 2.14 | 42 | 41 | Yes | 20 | 15.8 | 65 | 3 | | | TTN | p.Ala12675 |
| HFA-26 | F | 1.56 | 51 | 45 | No | 40 | 29.2 | 48 | 2 | | | TTN | p.Val11879 |
| HFA-41 | M | 2.14 | 60 | 57 | No | 45 | 24 | 58 | 1 | | Episodic severe dypsnea | TTN | p.Val11879 |
| MDT-11 | F | 1.66 | 30 | 19 | Yes | 20 | 11 | 52 | 3 | | ICD(28) | TTN | p.Ala12873fs |
| MEQ-132 | M | 1.6 | 25 | 22 | Yes | 45 | 19.3 | 57 | 1 | | Familial Screening | TTN | p.Pro13298_Thr17642dup |
| HFA-68 | F | 1.83 | 40 | 37 | Yes | 45 | 21.4 | 56 | 1 | | CHF, ICD(38) NSVT | TTN | p.Glu14779fs |
| MDD-22 | F | 1.88 | 73 | 57 | Yes | 20 | 18 | 58 | 2 | | ICD(70) | TTN | p.Asp14909 |
| MIV-14 | M | 1.9 | 50 | 26 | Yes | 20 | 9.5 | 63 | 3 | 49 | AF, CHF (35), ICD(47) | TTN | p.Asp14909 |
| HFA-71 | M | 2.05 | 61 | 40 | Yes | 15 | 11.3 | 80 | 4 | | CHF, ICD(56), NSVT | TTN | p.Asp16122 |
| HFA-63 | M | 2.25 | 32 | 29 | Yes | 15 | 15.9 | 63 | 4 | | CHF, ICD, NSVT | TTN | p.Glu17978fs |
| MGR-11 | F | 1.58 | 59 | 53 | Yes | 20 | 9.7 | 62 | 2.5 | | CHF(53) | TTN | p.His18335 |
| MEH-11 | M | 2.36 | 28† | 25 | Yes | 11 | NA | NA | 4 | 28 | CHF, NSVT | TTN | p.Cys18789X |
| MDJ-21 | M | 2.13 | 35 | NA | NA | 40 | 21 | 64 | 3 | | ICD, NSVT | TTN | p.Arg18858X |
| MEW-11 | M | 1.97 | 37† | 20 | Yes | 25 | NA | 50 | 4 | 31, 37 | | TTN | p.Arg18985X |
| MAO-92 | F | 1.6 | 36 | 17 | Yes | 37.5 | 22.4 | 63 | 2 | | ICD(33) | TTN | p.Trp976Arg/p.Arg19560X |
| MAM-12 | M | 1.79 | 23 | 23 | Yes | 32.5 | 25 | 68 | 4 | 23 | ICD, NSVT, SMD | TTN | p.Gln20809* |
| MIS-11 | F | 1.8 | 62 | 59 | Yes | 20 | 25.5 | 61 | 2 | | AF, CHF | TTN | p.Thr21135 |
| MCL-15 | F | 1.53 | 54 | 24 | Yes | 28 | 18 | 51 | 3 | | ICD(35) | TTN | p.Tyr21301 |
| MHG-23 | M | 1.98 | 52 | 31 | Yes | 29 | 14.3 | 77 | 4 | 52 | AF, CHF, ICD(46) | TTN | p.Ala22353fs |
| MEK-111 | M | 1.94 | 24† | 15 | Yes | NA | 17 | 77 | 4 | 15, 24 | CHF | TTN | p.Pro22582fs |
| HFA-57 | F | 1.98 | 55 | 48 | Yes | 22.5 | 13.7 | 51 | 2 | 55 | AF, CHF, Nl Cors | TTN | p.Gln24059fs |
| SS287-15 | F | 1.97 | 54 | 45 | Yes | 45 | 36 | 55 | 1 | | Familial Screening; RVD, SVT | TTN | p.Ser24241fs |
| MID-1 | M | 1.83 | 40 | 37 | Yes | 34 | 15.7 | 51 | 2 | | Familial Screening | TTN | p.Gln25689X |
| SS725 | M | 2.28 | 62 | 51 | Yes | 20 | 9.5 | 63 | 4 | | CHF, ICD(61) | TTN | p.Gln25689X |
| MGW-11 | M | NA | 40† | 35 | Yes | 12.5 | 13.3 | 98 | 4 | 40 | CHF, ICD | TTN | p.Arg26949X |
| MIP-13 | M | 2.33 | 41 | 33 | Yes | 30 | 16.5 | 51 | 2 | | CHF, ICD(33) NSVT; Nl Cors | TTN | p.Trp27147X |
| MIA-1 | M | 2.35 | 30 | 14 | Yes | 32.5 | 25 | 68 | 2 | | ICD, NSVT | TTN | p.Glu27300 |
| MBG-121 | M | 2.21 | 34 | 35 | Yes | 20 | NA | NA | 3 | | CHF, ICD | TTN | p.Glu29510X |
| HFA-46 | M | 1.9 | 66 | 53 | Yes | 20 | 57 | 62 | 3 | | AF, AI, ICD | TTN | p.Thr29725fs |
| MHQ-12 | M | 2.07 | 42 | 38 | Yes | 17.5 | 9.7 | 72 | 1 | | CHF, ICD(41) | TTN | p.Gln30081X |
| SS723 | M | NA | 56 | 51 | Yes | 15 | 38 | 67 | 3 | | AF, ICD(52) | TTN | p.Thr30165 |
| HFA-83 | M | 1.98 | 45 | 40 | Yes | 20 | 15.2 | 66 | 4 | | AF, CHF, ICD | TTN | p.Arg30857 |
| HFA-66 | M | 2.04 | 29 | 28 | Yes | 22.5 | 13 | 77 | 3 | 29, 32 | ICD(29), NSVT | TTN | p.Arg30857 |
| MHX-11 | M | 2.24 | 58† | 52 | Yes | 32.5 | 8.2 | 61 | 3.5 | 58 | CHF | TTN | p.Lys31371X |
| HFA-10 | M | | 64 | 57 | NA | 15 | 5.9 | 84 | 2 | 64 | ICD(58) | | |
| HFA-30 | M | | 62 | 55 | No | 25 | 22.6 | 62 | 2 | 60 | IC(54) NSVT | | |
| HFA-37 | M | | 38 | 18 | No | 35 | 22.6 | 53 | 1 | | NSVT | | |
| HFA-43 | M | | 47 | 37 | No | 45 | 22.2 | 54 | 1 | | | | |
| HFA-50 | M | | 51 | 47 | No | 20 | 16.7 | 60 | 3 | | ICD(49) | | |
| HFA-51 | M | | 43 | 33 | No | 30 | 18.3 | 71 | 2 | | ICD | | |
| HFA-53 | F | | 51 | 47 | Yes | 55 | 25 | 44 | 1 | | Familial Screening; Abn | | |

TABLE 11-continued

Clinical characteristics of DCM-A probands

| Subject | Sex | BSA (m2) | Current age (yr) or death† | Age of Dx (yr) | Family Hx | LVEF (%)‡ | FS (%)‡ | LVEDD (mm)‡ | NYHA class¶ | Age at VAD, Tx, Death (yr) | Comments | Gene | Mutation(s)✕ |
|---|---|---|---|---|---|---|---|---|---|---|---|---|---|
| HFA-56 | M | | 37 | 33 | Yes | 35 | 20.4 | 54 | 1 | | LV wall motion; Nl Cors; NSVT; ICD(47) | | |
| HFA-61 | F | | 63 | 47 | Yes | 37.5 | 8.8 | 57 | 4 | | ICD(62) | | |
| HFA-67 | M | | 49 | 43 | NA | 15 | 14.5 | 69 | 4 | 45 | CAD, ICD(41) | | |
| HFA-70 | F | | 74 | 58 | Yes | 25 | 12.7 | 71 | 3 | | AF, ICD, NSVT | | |
| JG-32 | F | | 51 | 43 | Yes | 45 | 38 | 60 | 3 | | ICD(45) SM, Nl Cors | | |
| MAB-17 | F | | 31 | 22 | Yes | 27 | 21.2 | 66 | 3 | 33 | ICD(33) | | |
| MAE-3111 | M | | 35 | 34 | Yes | 25 | 57 | 15.8 | 3 | 58 | AF, ICD(35), NSVT | | |
| MAG-3 | F | | 69 | 50 | Yes | 35 | 18 | 56 | 3 | | | | |
| MAK-13 | M | | 38 | 61 | Yes | 40 | 22 | 70 | 3 | | ICD(39) | | |
| MBS-1 | M | | 65 | 65 | Yes | 42.5 | 30.8 | 65 | 1 | | AF | | |
| MCH-123 | M | | 12 | 12 | Yes | 30 | 15.4 | 65 | 1 | 13 | ICD(12) | | |
| MDK-11 | M | | 53 | NA | Yes | 52 | NA | NA | NA | | | | |
| MDU-111 | F | | 43 | 31 | Yes | NA | NA | NA | NA | | | | |
| MDX-11 | F | | 40 | 37 | Yes | 40 | 36 | 61 | 1 | | Family Screening | | |
| MEE-11 | M | | 44 | 32 | Yes | 40 | 22.6 | 62 | 2 | | ICD(34) VT | | |
| MEI-112 | M | | 27 | 17 | Yes | NA | NA | NA | NA | | | | |
| MEM-11 | M | | 18 | 10 | Yes | NA | NA | NA | 4 | 12 | CHF | | |
| MEN-111 | M | | 31 | 12 | Yes | 42.5 | 22.6 | 62 | 1 | | AF, ICD, NSVT | | |
| MEP-111 | M | | 46 | 23 | Yes | 45 | 22 | 61 | NA | | | | |
| MER-11 | M | | 54 | 38 | Yes | 18 | NA | 60 | 3 | | ICD(38) | | |
| MEX-1 | M | | 53 | NA | Yes | 9 | NA | 70 | NA | | VT, CAD | | |
| MGL-11 | F | | 27 | 25 | Yes | 30 | 16.1 | 62 | 2 | 27 | SMD | | |
| MGM-1 | F | | 73 | 36 | Yes | 30 | 14 | 50 | 2 | | AF, ICD, NSVT | | |
| MGP-1 | M | | 58 | 57 | Yes | 44 | 29.7 | 64 | 2 | | ICD(58) | | |
| MGS-111 | M | | 30 | 25 | No | 50 | NA | 59 | 1 | | Nl Cors; Syncope | | |
| MGU-111 | M | | 41 | NA | Yes | NA | NA | NA | NA | 32 | | | |
| MGY-123 | M | | 35 | 34 | Yes | 15 | 12.3 | 65 | NA | | | | |
| MHA-145 | F | | 37 | 34 | Yes | 40 | 31.5 | 54 | 3 | 34 | ICD(34) NSVT | | |
| MHE-113 | M | | 54 | NA | Yes | 22.5 | 12.5 | 64 | 4 | 54 | ICD, AVB | | |
| MHF-11 | F | | 43 | 40 | Yes | 15 | 8.9 | 56 | 1 | | AF, ICD(41) | | |
| MHI-11 | M | | 70† | 56 | Yes | NA | NA | NA | 3 | 70 | AF | | |
| MIF-14 | M | | 42 | 42 | Yes | 35 | 30.6 | 62 | 2 | | | | |
| MIJ-1 | M | | 49 | 29 | Yes | 15 | 5.2 | 77 | 4 | 47 | ICD(40) NSVT | | |
| MIK-111 | F | | 38 | NA | Yes | 40 | 27.6 | 58 | 1 | 37 | SCD; ICD(37) | | |
| MIM-11 | F | | 49 | 33 | Yes | 20 | 13.2 | 68 | 4 | 46 | ICD(45) | | |
| MI0-13 | M | | 28 | 25 | Yes | 30 | NA | 55 | 2 | | Familial Screening | | |
| MJ-11 | M | | 26 | 17 | Yes | NA | NA | 69 | 4 | 26 | WPW, RVF | | |
| MT13 | M | | 48 | 18 | Yes | 30 | 31 | 56 | 1 | | Familial Screening; AVB; SVT; LV biopsy, myocarditis negative | | |
| MW-11 | M | | 61 | 43 | Yes | 20 | 12.5 | 64 | 2 | | ICD(56) | | |

TABLE 11-continued

Clinical characteristics of DCM-A probands

| Subject | Sex | BSA (m2) | Current age (yr) or death† | Age of Dx (yr) | Family Hx | LVEF (%)‡ | FS (%)‡ | LVEDD (mm)‡ | NYHA class¶ | Age at VAD, Tx, Death (yr)^ | Comments□ | Gene | Mutation(s)✕ |
|---|---|---|---|---|---|---|---|---|---|---|---|---|---|
| MYC-11 | M | | 53 | 43 | Yes | 15 | 9.9 | 71 | 1 | | AF, ICD(50) | | |
| SS126 | M | | 38 | 28 | Yes | 38 | 18.8 | 64 | 1 | | ICD | | |
| SS705 | F | | 42 | 33 | Yes | 15 | 5 | 59 | 4 | 41 | MR | | |
| SS719 | F | | 60 | 45 | Yes | 20 | 6.3 | 64 | 4 | | CHF; Nl Cors | | |
| SS720 | M | | 67 | 52 | NA | 25 | 10.3 | 68 | 2 | | ICD(66), NSVT | | |
| SS731 | M | | 65 | 65 | No | 25 | 16.6 | 66 | 3 | | AF, MR, Nl Cors | | |
| MHM-22 | M | | 29 | 19 | Yes | 40 | 28.8 | 59 | 1 | | | | |
| HFA-65 | F | | 54 | 51 | Yes | 42.5 | 14.8 | 54 | 1 | | ICD(50) | | |
| MHO-4 | M | | 60 | 54 | Yes | 20 | 13.6 | 66 | 1 | | ICD(54), NSVT, mild CAD | | |

BSA, body surface area (m2) is provided for subjects with TTN mutations;
Age of Dx, age of diagnosis;
Family Hx, Familial history of DCM.
‡Echocardiographic measurements of left ventricular ejection fraction (EF), fractional shortening (FS) and left-ventricular end-diastolic diameter (LVEDD) obtained at time of diagnosis. NA, not available.
¶New York Heart Association classifications (NYHA) range from 1 to 4.
^Earliest ages at which subject received a ventricular assist device (VAD) or a cardiac transplant (Tx), or age at death.
|| Clinical data are denoted by: Abn LV wall motion, abnormal left ventricular wall motion identified by echocardiography; AF, atrial fibrillation; AI, aortic insufficiency; AVB, atrio-ventricular block; CHF, hospitalized for congestive heart failure; CVA, cerebral vascular accident; Familial screening, clinical evaluations were prompted by overt DCM in a first-degree relative; ICD, implanted cardiac defibrillator implanted at age (parentheses); MR, mitral regurgitation; PCM, pacemaker; Nl cors, normal coronary artery anatomy defined by cardiac angiography; NSVT, non-sustained ventricular tachycardia; WPW, Wolf Parkinson White; RVD, right ventricular dilation; RVF, right ventricular heart failure, SMD, skeletal muscle disease.
□TTN mutations are detailed in Tables 8 and 9.
*denotes homozygous mutation.

TABLE 12

Clinical characteristics of DCM-B probands

| Subject | Sex | BSA (m2) | Current age (yr) or death† | Age of Dx (yr) | Family Hx | LVEF (%)‡ | LVEDD (mm)‡ | NYHA Class¶ | Age at VAD, Tx, Death (yr)^ | Comments□ | Gene | Mutation(s)✕ |
|---|---|---|---|---|---|---|---|---|---|---|---|---|
| UK-H11 | F | 1.74 | 40 | 32 | No | 20 | 68 | 3 | 32 | | TTN | p.Cys13771X |
| UK-G1 | M | 1.9 | 49† | 46 | NA | 35 | 74 | 4 | 49 | | TTN | p.Phe15108fs |
| UK-A3 | M | 1.67 | 30 | 18 | No | 24 | 79 | 2 | 19 | | TTN | p.Gly16189X |
| UK-B1 | M | 2.1 | 71 | 50 | No | 50 | 55 | 4 | 60 | RVF RVEF = 14% | TTN | p.Glu18141 |
| UK-B12 | M | 1.78 | 39 | 30 | No | 6 | 81 | 4 | 31 | | TTN | p.Val11879 p.Asp18235 |
| UK-A10 | M | 1.88 | 55† | 49 | No | 29 | 64 | 4 | 55 | | TTN | p.Arg20858X |
| UK-B2 | M | NA | 42† | 37 | No | 23 | 70 | 4 | 42 | | TTN | p.Gly21497 |
| UK-H2 | M | 2.09 | 51 | 39 | Yes | 18 | 80 | 3 | 41 | | TTN | p.Lys21640fs |
| UK-C8 | M | NA | 55† | 37 | NA | 11 | 76 | 4 | 55 | | TTN | p.Glu21956fs |
| UK-C6 | M | 1.83 | 41 | 31 | No | 29 | 67 | 3 | 31 | | TTN | p.Ser27179fs |
| UK-B6 | M | 2.19 | 38† | 30 | NA | 38 | 82 | 4 | 38 | | TTN | p.Tyr27567X |
| UK-E12 | M | 1.8 | 57 | 49 | No | 21 | 78 | 4 | 51 | ICD | TTN | p.Tyr28326fs |
| UK-C10 | M | NA | 38 | 29 | No | 34 | 73 | 4 | 30 | | TTN | p.Arg29415X |
| UK-E4 | M | NA | 42 | 32 | No | 18 | 61 | 4 | 32 | | TTN | p.Thr30513fs |
| UK-G7 | F | 1.78 | 63 | 53 | Yes | 14 | 59 | 3 | 54 | | TTN | p.Arg31126fs |
| UK-G9 | M | 2.2 | 50† | 43 | No | 17 | 70 | 3 | 50 | | TTN | p.Arg31195X |
| UK-C9 | M | NA | 62 | 49 | Yes | 32 | 66 | 4 | 54 | | TTN | p.Ser31841X |
| UK-A2 | M | | 60 | 49 | NA | 44 | 69 | 3 | 49 | | | |
| UK-A4 | M | | 40 | 29 | No | 15 | 87 | 3 | 29 | AVR | | |
| UK-A5 | M | | 40 | 30 | No | 16 | 72 | 3 | 31 | | | |
| UK-A7 | M | | 26 | 17 | NA | NA | NA | 3 | 17 | | | |
| UK-A8 | M | | 50 | 40 | No | 17 | 81 | 3 | 45 | | | |
| UK-A9 | M | | 69 | 48 | No | 20 | 69 | 3 | 60 | | | |
| UK-A12 | M | | 58 | 48 | NA | 18 | 78 | 2 | | | | |
| UK-B3 | M | | 44† | 32 | NA | 33 | 72 | 4 | 44 | | | |
| UK-B7 | M | | 52† | 41 | NA | 19 | 80 | 4 | 52 | | | |
| UK-B8 | M | | 63 | 50 | NA | 8 | 90 | 3 | 54 | AF | | |
| UK-B9 | F | | 50† | 49 | NA | 26 | 66 | 4 | 50 | ICD | | |
| UK-B10 | M | | 67 | 53 | NA | 18 | 57 | 3 | 59 | PCM | | |

TABLE 12-continued

Clinical characteristics of DCM-B probands

| Subject | Sex | BSA (m2) | Current age (yr) or death† | Age of Dx (yr) | Family Hx | LVEF (%)‡ | LVEDD (mm)‡ | NYHA Class¶ | Age at VAD, Tx, Death (yr)^ | Comments□ | Gene | Mutation(s)✕ |
|---|---|---|---|---|---|---|---|---|---|---|---|---|
| UK-B11 | F |  | 57 | 51 | Yes | 34 | 62 | 3 | 52 | PCM |  |  |
| UK-C1 | F |  | 64 | 51 | Yes | 31 | 61 | 3 | 53 |  |  |  |
| UK-C3 | M |  | 46 | 29 | NA | 27 | 79 | 3 | 35 |  |  |  |
| UK-C4 | F |  | 66 | 55 | NA | 32 | 69 | 2 |  |  |  |  |
| UK-C5 | M |  | 57 | 46 | NA | 24 | 66 | 3 | 47 |  |  |  |
| UK-C7 | M |  | 60 | 43 | NA | 32 | 78 | 4 | 59 |  |  |  |
| UK-C12 | F |  | 28† | 28 | NA | 15 | 64 | 3 | 28 |  |  |  |
| UK-D1 | M |  | 62 | 46 | No | 37 | 78 | 3 | 51 |  |  |  |
| UK-D3 | F |  | 44 | 33 | Yes | 44 | 69 | 3 | 34 |  |  |  |
| UK-D4 | M |  | 47 | 36 | No | 35 | 63 | 3 |  |  |  |  |
| UK-D6 | M |  | 59† | 57 | NA | 44 | 75 | 4 | 59 | AF |  |  |
| UK-D8 | M |  | 43† | 38 | NA | 9 | 98 | 4 | 43 |  |  |  |
| UK-D9 | M |  | 32 | 13 | NA | 20 | 54 | 3 | 23 |  | TTN |  |
| UK-D10 | M |  | 28 | 18 | No | 5 | 59 | 3 | 20 |  |  |  |
| UK-D11 | F |  | 65 | 54 | NA | 6 | 74 | 3 | 57 |  |  |  |
| UK-D12 | M |  | 44† | 39 | Yes | 12 | 76 | 3 | 39, 44 |  |  |  |
| UK-E3 | F |  | 43 | 27 | No | 20 | 71 | 3 | 32 |  |  |  |
| UK-E6 | M |  | 69 | 58 | NA | 11 | 74 | 3 | 59 | PCM |  |  |
| UK-E9 | M |  | 50 | 17 | NA | 21 | 65 | 3 | 41 | PCM |  |  |
| UK-E7 | M |  | 32† | 26 | NA | 10 | 91 | 4 | 32 |  |  |  |
| UK-E10 | M |  | 61† | 56 | NA | 30 | 88 | 4 | 61 | AF |  |  |
| UK-E11 | M |  | 60 | 52 | YES | 18 | 80 | 3 | 52 |  |  |  |
| UK-F1 | M |  | 71 | 59 | Yes | 27 | 71 | 3 | 60 | PCM |  |  |
| UK-F3 | M |  | 42† | 29 | NA | 13 | 62 | 4 | 42 |  |  |  |
| UK-F4 | M |  | 57† | 52 | No | 45 | 71 | 4 | 57 |  |  |  |
| UK-F5 | F |  | 27 | 13 | No | 20 | 94 | 3 | 16 | PCM |  |  |
| UK-F6 | M |  | 55 | 21 | NA | 20 | 87 | 3 | 45 |  |  |  |
| UK-F7 | F |  | 64 | 54 | No | 49 | 57 | 2 |  |  |  |  |
| UK-F9 | M |  | 51† | 50 | NA | 23 | 77 | 3 | 51 |  |  |  |
| UK-F10 | M |  | 50 | 36 | NA | 21 | 91 | 2 |  | AF, ICD |  |  |
| UK-F11 | M |  | 52† | 52 | NA | 23 | 73 | 4 | 52 |  |  |  |
| UK-G2 | F |  | 44 | 31 | NA | 30 | 63 | 2 |  |  |  |  |
| UK-G3 | M |  | 58† | 56 | NA | 40 | 76 | 4 | 58 |  |  |  |
| UK-G5 | F |  | 17† | 16 | No | 44 | 77 | 4 | 17 |  |  |  |
| UK-G6 | M |  | 46† | 45 | NA | 34 | 67 | 4 | 46 |  |  |  |
| UK-G8 | F |  | 61 | 47 | No | 30 | 61 | 3 | 57 |  |  |  |
| UK-G11 | M |  | 67 | 56 | No | 28 | 80 | 3 | 59 |  |  |  |
| UK-H3 | M |  | 62 | 51 | No | 17 | 72 | 3 | 52 |  |  |  |
| UK-H4 | M |  | 57 | 47 | No | 11 | 78 | 3 | 47 |  |  |  |
| UK-H8 | F |  | 66 | 56 | No | 30 | 71 | 3 | 57 |  |  |  |
| UK-H9 | M |  | 64 | 54 | No | 48 | 93 | 3 |  |  |  |  |
| UK-H12 | M |  | 46† | 46 | No | 10 | NA | 4 | 46 |  |  |  |

Footnotes for symbols (†‡¶||□) and abbreviations are defined in Table 11.
Additional abbreviations used: AVR, aortic valve replacement;
RVEF, right ventricular ejection fraction.

TABLE 13

Clinical characteristics of DCM-C probands

| Subject | Sex | BSA (m2) | Current age (yr) or death† | Age of Dx (yr) | Family Hx | LVEF (%)‡ | FS (%)‡ | LVEDD (mm)‡ | NYHA class¶ | Age at VAD, Tx, Death (yr)^ | Comments□ | Gene | Mutation(s)✕ |
|---|---|---|---|---|---|---|---|---|---|---|---|---|---|
| TSSDC011-450 | M | 2.1 | 53 | 45 | No | 37 | 12 | 82 | 2 |  |  | TTN | p.Arg2083fs |
| DNFDC144-05-0444 | F | 2.18 | 54 | 32 | Yes | 45 | NA | 57 | 2 |  |  | TTN | p.Trp16359X |
| TSFDC023-300 | F | 1.75 | 38 | 20 | Yes | 26 | 15 | 60 | 1 |  |  | TTN | p.Lys16782 |
| DNFDC116-04-1545 | M | 1.96 | 33 | 21 | Yes | 40 | 15 | 54 | 1 |  |  | TTN | pArg17295X |
| TSFDC050-115 | M | 1.74 | 53 | 35 | Yes | 24 | 13 | 70 | 3 |  |  | TTN | p.Arg17470X |

TABLE 13-continued

Clinical characteristics of DCM-C probands

| Subject | Sex | BSA (m2) | Current age (yr) or death† | Age of Dx (yr) | Family Hx | LVEF (%)‡ | FS (%)‡ | LVEDD (mm)‡ | NYHA class¶ | Age at VAD, Tx, Death (yr)^ | Comments☐ | Gene | Mutation(s)✕ |
|---|---|---|---|---|---|---|---|---|---|---|---|---|---|
| TSFDC017-253-2 | M | 2.13 | 72 | 65 | Yes | 40 | 22 | 59 | 1 | | | TTN | p.Glu17715fs |
| DNFDC103-03-0941 | M | 2.48 | 57 | 45 | Yes | 30 | 10 | 74 | 2.5 | | | TTN | p.Glu17783X |
| DNFDC142-05-0569 | M | 1.79 | 30 | 23 | Yes | 20 | 15 | 69 | 2.5 | | | TTN | p.Arg18985X |
| DNFDC088-02-1900 | F | 2.04 | 40 | 38 | Yes | 25 | NA | 50 | 2 | | | TTN | p.Trp26632X |
| DNFDC081-02-1564 | M | 2.13 | 45 | 43 | Yes | 20 | 13 | 63 | 4 | 45 | | TTN | p.Lys27016X |
| TSSDC019-268 | F | 1.45 | 67 | 60 | No | 21 | 13 | 70 | 4 | | | TTN | p.Trp29318X |
| TSFDC002-23 | M | 1.79 | 57 | 43 | Yes | 29 | 10 | 72 | 1 | | | TTN | p.Arg29415X |
| TSFDC033-434 | M | 2.0 | 40 | 19 | Yes | 24 | 10 | 72 | 4 | | | TTN | p.Asn30348fs |
| TSFDC004-118 | M | | 41 | 37 | Yes | 18 | 10 | 57 | 3 | 41 | | | |
| DNFDC050-02-2210 | F | | 36 | 29 | Yes | 43 | 22 | 56 | 2 | | | | |
| DNFDC096-03-0005 | F | | 37 | 36 | No | 37 | NA | NA | NA | | | | |
| TSFDC049-4 | M | | 64 | 45 | Yes | 29 | 18 | 79 | 2 | | | | |
| TSXLC002-22 | M | | 38 | 19 | Yes | 25 | 7 | 83 | 2 | | | | |
| TSFDC007-28 | F | | 42 | 20 | Yes | 20 | 11 | 73 | 2 | | | | |
| TSFDC047-120 | M | | 35 | 30 | Yes | 39 | 12 | 52 | 4 | 35 | | | |
| TSXLC001-131 | M | | 31 | 31 | Yes | 28 | 15 | 60 | 4 | 42 | | | |
| TSFDC010-134 | M | | 46 | 36 | No | 29 | 15 | 71 | 3 | | | | |
| TSFDC003-136 | F | | 51 | 54 | Yes | 34 | NA | 62 | 1 | | | | |
| TSLVN002-156 | M | | 24 | 18 | Yes | 17 | | 74 | 1 | | | | |
| TSLVN001-172 | F | | 57 | 41 | Yes | 35 | 18 | 56 | 1 | | | | |
| TSFDC013-206 | F | | 26† | 25 | Yes | NA | | 51 | 4 | 26 | | | |
| TSFDC014-208 | F | | 60 | 43 | No | 41 | 21 | 62 | 1 | | | | |
| TSFDC015-230-2 | M | | 49 | 34 | Yes | 38 | 24 | 63 | 1 | | | | |
| TSFDC016-254-2 | M | | 59 | 44 | Yes | 32 | 20 | 66 | 2 | | | | |
| TSFDC026-311 | M | | 27 | 14 | Yes | 27 | 16 | 53 | 4 | 27 | | | |
| TSFDC029-409 | F | | 59 | 46 | Yes | 42 | 20 | 56 | 2 | | | | |
| TSFDC027-419 | M | | 52† | 35 | Yes | 22 | 17 | 69 | 4 | 52 | | | |
| TSFDC032-430 | M | | 39 | 22 | Yes | 23 | 8 | 76 | 3 | | | | |
| TSFDC031-438 | M | | 48† | 44 | Yes | 17 | 5 | 75 | 4 | 48 | | | |
| DNFDC020-99-0824 | M | | 60 | 55 | Yes | 45 | 20 | 59 | 3 | | | | |
| DNFDC010-01-0045 | M | | 58 | 56 | Yes | 45 | NA | 71 | 3 | | | | |
| DNFDC053-01-0081 | M | | 42 | 41 | Yes | 60 | 34 | 60 | 1 | | Abn LV wall motion | | |
| DNFDC058-01-0341 | F | | 37 | 31 | Yes | 32 | NA | NA | 2 | | | | |
| DNFDC055-01-0439 | F | | 39 | 38 | Yes | 10 | 5 | 90 | 2 | | | | |
| TSFDC036-01-0729 | M | | 50 | 40 | Yes | 48 | 27 | 63 | 4 | 50 | | | |
| TSFDC039-01-0731 | F | | 55 | 54 | Yes | 23 | 26 | 69 | 4 | 55 | | | |

TABLE 13-continued

Clinical characteristics of DCM-C probands

| Subject | Sex | BSA (m2) | Current age (yr) or death† | Age of Dx (yr) | Family Hx | LVEF (%)‡ | FS (%)‡ | LVEDD (mm)‡ | NYHA class¶ | Age at VAD, Tx, Death (yr)^ | Comments□ | Gene | Mutation(s)✕ |
|---|---|---|---|---|---|---|---|---|---|---|---|---|---|
| DNFDC054-01-0937 | M | | 70 | 56 | Yes | 28.5 | NA | NA | 2 | | | | |
| DNFDC004-01-1624 | M | | 35 | 21 | Yes | NA | NA | NA | 2 | | | | |
| DNFDC065-01-2260 | M | | 66 | 55 | Yes | 37 | 18 | 55 | 2 | | | | |
| DNFDC066-01-2393 | F | | 39 | 34 | Yes | 50 | 23 | 57 | 1 | | | | |
| DNFDC068-02-0053 | M | | 47 | 45 | Yes | 50 | 18 | 67 | 4 | 47 | | | |
| TSFDC040-02-0169 | M | | 37 | 28 | Yes | 52 | 25 | 61 | 1 | | | | |
| TSFDC041-02-0176 | M | | NA | 45 | Yes | 24 | 6 | 63 | 2 | | | | |
| TSFDC042-02-0191 | F | | 60 | 46 | Yes | 22 | 15 | 72 | 4 | 46 | | | |
| TSFDC038-02-0225 | F | | 62 | 48 | Yes | 46 | 20 | 58 | 1 | | | | |
| DNFDC071-02-0394 | F | | 76 | 58 | Yes | 45 | 29 | 41 | 2 | | | | |
| DNFDC073-02-0502 | M | | 19 | 18 | Yes | 25 | 11 | 56 | 2 | | | | |
| DNFDC072-02-0503 | M | | 44† | 32 | No | 19 | 12 | 89 | 4 | 44 | | | |
| DNFDC069-02-0646 | F | | 36 | 28 | Yes | 30 | 22 | 62 | 2 | | | | |
| DNFDC074-02-0911 | F | | 53 | 46 | Yes | 35 | NA | NA | 2 | | | | |
| DNFDC077-02-0954 | M | | 46† | 44 | Yes | 10 | NA | NA | 46 | | | | |
| TSFDC018-02-1027 | M | | 74 | 33 | Yes | 40 | 19 | 61 | 2 | | | | |
| TSFDC045-02-1089 | M | | 60 | 49 | Yes | 40 | 20 | 64 | 2 | | | | |
| TSFDC025-02-1092 | M | | 41 | 28 | Yes | 22 | 21 | 70 | 2 | | | | |
| TSFDC044-02-1097 | M | | 34 | 26 | Yes | 43 | 18 | 56 | 1 | | | | |
| DNFDC078-02-1192 | M | | 48† | 39 | Yes | 20 | NA | NA | 3 | 48 | | | |
| DNFDC079-02-1517 | F | | 34 | 33 | Yes | 20 | 15 | 55 | 3 | | | | |
| DNFDC029-02-1532 | F | | 76 | 62 | Yes | 25 | 13 | NA | 2 | | | | |
| DNFDC083-02-1566 | F | | 69 | 38 | Yes | 30 | 20 | 74 | 2 | | | | |
| DNFDC030-02-1612 | M | | 40 | 29 | Yes | 21 | 9 | 75 | 3 | | | | |
| DNFDC087-02-1758 | F | | 48 | 22 | Yes | 11 | 9 | 81 | 3 | | | | |
| DNFDC013-02-1902 | F | | 44 | 37 | Yes | 37 | 11 | 62 | 2 | | | | |
| DNFDC042-02-2037 | F | | 53 | 52 | Yes | 20 | 11 | 64 | 4 | 53 | | | |
| DNFDC034-02-2053 | M | | 64 | 53 | No | 35 | NA | 74 | 3 | | | | |
| DNFDC090-02-2104 | M | | 47 | 47 | Yes | 41 | 22 | 84 | 2 | | | | |
| DNFDC089-02-2151 | F | | 38 | 31 | Yes | 25 | 14 | 80 | 3 | | | | |
| TSFDC009-02-2276 | M | | 67 | 44 | Yes | 26 | 13 | 83 | 1 | | | | |
| TSFDC022-02-2304 | F | | 60 | 44 | No | 40 | 28 | 56 | 1 | | | | |
| DNFDC092-02-2349 | F | | 39 | 38 | Yes | 45 | NA | NA | 2 | | | | |
| DNFDC091-02-2555 | M | | 43 | 35 | Yes | 31 | 20 | 54 | 2.5 | | | | |
| DNFDC099-03-0432 | F | | 32 | 30 | Yes | 17 | 16 | 66 | 3 | | | | |

TABLE 13-continued

Clinical characteristics of DCM-C probands

| Subject | Sex | BSA (m2) | Current age (yr) or death† | Age of Dx (yr) | Family Hx | LVEF (%)‡ | FS (%)‡ | LVEDD (mm)‡ | NYHA class¶ | Age at VAD, Tx, Death (yr)^ | Comments☐ | Gene | Mutation(s)✕ |
|---|---|---|---|---|---|---|---|---|---|---|---|---|---|
| DNFDC100-03-0433 | M | | 49 | 39 | Yes | 27 | 13 | 80 | 3 | 49 | | | |
| DNFDC108-03-2056 | F | | 61 | 49 | Yes | 29 | 14 | NA | 2 | | | | |
| DNFDC016-04-0243 | F | | 38 | 36 | Yes | 15 | 15 | 60 | 3 | | | | |
| DNFDC109-04-0326 | F | | 59 | 58 | Yes | 30 | 13 | 67 | 2 | | | | |
| DNFDC014-04-0567 | M | | 50 | 34 | Yes | 17 | NA | NA | 3 | | | | |
| DNFDC114-04-0871 | F | | 42 | 41 | Yes | 40 | 23 | 47 | 2 | | | | |
| DNFDC112-04-0906 | F | | 55 | 38 | Yes | 19 | 12 | 66 | 3 | | | | |
| DNFDC117-04-1674 | M | | 60 | 50 | Yes | 15 | 11 | 55 | 2.5 | | | | |
| DNFDC123-05-0110 | F | | 65 | 63 | Yes | 30 | 26 | 49 | 2.5 | | | | |
| DNFDC133-05-0199 | M | | 50 | 47 | No | 17 | 5 | 66 | 2 | | | | |
| DNFDC039-05-0234 | M | | 54 | 50 | Yes | 34 | 17 | 64 | 2.5 | | | | |
| DNFDC131-05-0381 | F | | 28 | 24 | Yes | 25 | 11 | 64 | 3 | | | | |
| DNFDC139-05-0394 | M | | 45 | 30 | No | 33 | NA | NA | 3 | | | | |
| DNFDC147-05-0548 | F | | 36 | 33 | Yes | 25 | NA | 64 | 2 | | | | |
| DNFDC155-05-0698 | F | | 49 | 43 | Yes | 47 | 21 | 50 | 2 | | | | |
| DNFDC141-05-0716 | F | | 22 | 18 | Yes | 18 | 14 | 64 | 2.5 | | | | |
| TSAR004-6 | M | | 73 | 53 | Yes | 50 | 32 | 61 | 1 | | | | |
| TSAR003-35-2 | M | | 14 | 12 | Yes | 31 | 7 | 56 | 2 | 14 | | | |
| TSAR005-125 | M | | 37 | 19 | Yes | 37 | 18 | 65 | 1 | | | | |
| TSFDC001-98-38 | M | | 51 | 29 | Yes | 21 | 11 | 87 | 1 | | | | |
| TSSDC128-220 | M | | 42 | 38 | No | 37 | 24 | 59 | 4 | 42 | | | |
| TSSDC012-273 | M | | 69 | 53 | Yes | 38 | 19 | 64 | 2 | | | | |
| TSSDC116-292 | M | | 24 | 23 | No | 18 | 13 | 61 | 4 | 24 | | | |
| TSSDC020-395 | F | | 56 | 39 | No | 33 | 20 | 59 | 2 | | | | |
| TSSDC009-398-2 | F | | 59 | 46 | Yes | 18 | 16 | 89 | 4 | 59 | | | |
| TSSDC024-401 | M | | 50† | 38 | No | 17 | 15 | 89 | 4 | 50 | | | |
| TSSDC026-433 | F | | 71 | 51 | No | 25 | 10 | 68 | 2 | | | | |
| TSSDC027-435 | M | | 50† | 44 | No | 29 | 9 | 78 | 2 | | | | |
| TSSDC028-436 | M | | 32 | 25 | No | 22 | 10 | 79 | 2 | 32 | | | |
| TSSDC030-439 | M | | 61 | 44 | No | 28 | 10 | 79 | 3 | | | | |
| TSSDC031-441 | M | | 69† | 56 | No | 29 | 19 | 67 | 2 | 69 | | | |
| TSSDC032-442 | M | | 74 | 57 | Yes | 37 | 11 | 77 | 2 | | | | |
| TSSDC033-443 | M | | 58 | 46 | No | 26 | 9 | 64 | 1 | | | | |
| TSSDC002-445-2 | M | | 51 | 39 | No | 17 | 6 | 77 | 4 | 51 | | | |
| TSFDC005-127 | F | | 52 | 34 | Yes | 35 | 16 | 60 | 4 | | | | |

TABLE 13-continued

Clinical characteristics of DCM-C probands

| Subject | Sex | BSA (m2) | Current age (yr) or death† | Age of Dx (yr) | Family Hx | LVEF (%)‡ | FS (%)‡ | LVEDD (mm)‡ | NYHA class¶ | Age at VAD, Tx, Death (yr)^ | Comments☐ | Gene | Mutation(s)✕ |
|---|---|---|---|---|---|---|---|---|---|---|---|---|---|
| TSFDC012-148-2 | M | | 58 | 41 | Yes | 61 | 24 | 50 | 1 | | Familial Screening; NSVT, AF | | |
| TSSDC004-447 | M | | 76 | 55 | No | 45 | 16 | 83 | 3 | | | | |
| TSSDC005-448 | M | | 65† | 53 | No | NA | 12 | 67 | 4 | 65 | | | |
| TSSDC007-449 | M | | 72 | 53 | No | 25 | 13 | 70 | 2 | | | | |
| TSSDC014-451 | M | | 72† | 48 | No | 42 | 14 | 65 | 3 | 72 | | | |
| TSSDC015-452 | M | | 48 | 48 | No | 40 | 30 | 63 | 1 | | | | |
| DNFDC052-01-0131 | M | | 21 | 17 | Yes | NA | 27 | 57 | 2 | 21 | | | |
| DNFDC057-01-0987 | F | | 59 | 48 | Yes | 30 | 25 | NA | 2 | 59 | | | |
| DNFDC084-02-1567 | F | | 52 | 42 | No | 10 | NA | 69 | 2 | | | | |
| DNFDC095-02-2523 | M | | 54 | 44 | Yes | 10 | 6 | 78 | 2 | | | | |
| DNFDC113-04-0881 | F | | 45 | 44 | Yes | 25 | NA | NA | NA | NA | | | |
| DNFDC138-05-0395 | F | | 27 | 21 | No | 20 | 5 | 53 | 3 | | | | |
| DNFDC080-02-1405 | M | | 52 | 33 | Yes | 30 | 7 | 53 | 3 | 52 | | | |
| DNFDC094-02-2524 | M | | 68 | 52 | yes | 21 | 20 | 63 | 1 | | | | |
| DNFDC101-03-0942 | F | | 61 | 50 | No | 25 | 14 | 60 | 2 | | | | |
| DNFDC104-03-2029 | F | | 37 | 27 | No | 30 | 16 | 60 | 2 | | | | |
| DNFDC110-04-0347 | M | | 59 | 58 | No | 28 | 12 | 58 | 2 | | | | |
| DNFDC119-04-1877 | M | | 55 | 49 | Yes | 15 | 23 | 70 | 2 | | | | |
| DNFDC127-05-0160 | M | | 55 | 44 | No | 18 | NA | NA | 3 | | | | |
| DNFDC140-05-0355 | F | | 39 | 31 | No | 40 | 25 | 60 | 2 | | | | |
| DNFDC075-02-0970 | M | | | 31 | Yes | 52 | | | | | | | |
| DNFDC136-05-0301 | F | | | 23 | No | 50 | | | | | | | |
| TSSDC010-01-0745-2 | M | | | 56 | No | 49 | | | | | | | |
| DNFDC102-03-2097 | F | | | 27 | No | 48 | | | | | | | |
| TSFDC067-02-2315 | M | | | 13 | No | 47 | | | | | | | |
| DNFDC093-03-0646 | M | | | 58 | No | 47 | | | | | | | |
| DNFDC047-02-0952 | F | | | 49 | No | 46 | | | | | | | |
| TSFDC054-03-0818 | M | | | 27 | No | 46 | | | | | | | |
| DNFDC107-03-1827 | F | | | 40 | Yes | 42 | | | | | | | |
| DNFDC026-02-1565 | M | | | 63 | No | 36 | | | | | | | |
| TSFDC069-02-2322 | F | | | 50 | No | 35 | | | | | | | |
| DNFDC059-01-2291 | M | | | 58 | No | 33 | | | | | | | |
| TSSDC058-03-0817 | M | | | 20 | No | 30 | | | | | | | |
| DNFDC118-04-1787 | M | | | 22 | No | 29 | | | | | | | |
| TSSDC056-02-0174 | F | | | 47 | No | 28 | | | | | | | |

TABLE 13-continued

Clinical characteristics of DCM-C probands

| Subject | Sex | BSA (m2) | Current age (yr) or death† | Age of Dx (yr) | Family Hx | LVEF (%)‡ | FS (%)‡ | LVEDD (mm)‡ | NYHA class¶ | Age at VAD, Tx, Death (yr)^ | Comments□ | Gene | Mutation(s)✕ |
|---|---|---|---|---|---|---|---|---|---|---|---|---|---|
| TSSDC060-01-0725 | M | | | 49 | No | 13 | | | | | | | |
| DNFDC008-02-2451 | F | | 66 | 61 | Yes | 55 | 29 | NA | 4 | 66 | Rapid Progression | | |
| DNFCD003-02-01704 | F | | 59 | 41 | Yes | 56 | 35 | NA | | | Familial Screening | | |

Footnotes for symbols (†‡¶||□) and abbreviations are defined in Table 11.
Additional abbreviations used: AVR. aortic valve replacement;
RVEF, right ventricular ejection fraction.

TABLE 14

Clinical findings in DCM families with TTN truncating mutations*

| Pedigree | ID | Sex | Current age (yr) or death† | Age at diagnosis (yr) | FS (%)‡ | LVEDD (mm)‡ | NYHA class¶ | Age of VAD/Tx/Death (yr)^ | Comment□ | Clinical Status | TTN Genotype(s)□ |
|---|---|---|---|---|---|---|---|---|---|---|---|
| DNFDC081 | 02-1564 | M | 45 | 43 | 13 | 63 | 4 | Tx(45) | EF = 20% | A | p.Lys27016X |
| | 02-1663 | M | 33 | 33 | 30.2 | 53 | 1 | | IVCD | A | + |
| DNFDC088 | 02-1900 | F | 40 | 38 | 16 | 50 | 2 | | EF = 25% | A | p.Trp26632X |
| | 2395 | M | 70 | 61 | 39 | 54 | 1 | | | I | - |
| | 1901 | F | 58 | 58 | 33 | 55 | 1 | | Diastolic Dysfunction, TWA | I | + |
| | 05-0427 | M | 47 | 45 | NA | NA | 4 | Tx(47) | ST, RBBB, LAFB | A | + |
| DNFDC103 | 03-0941 | M | 57 | 45 | 10 | 74 | 2.5 | | TWA, 1AVB EF = 30% | A | p.Glu17783X |
| | 05-1266 | M | 51 | 48 | NA | NA | 2 | | EF = 10% | A | + |
| DNFDC142 | 05-0569 | M | 30 | 23 | 15 | 69 | 2.5 | | TWA, LAFB, IVCD, EF = 20% | A | p.Arg18985X |
| | 0568 | F | 53 | 53 | NA | NA | 2 | | | I | + |
| MAO | 92 | F | 36 | 17 | 22.4 | 63 | 2 | | EF = 37% ICD(33) | A | p.Trp976Arg p.Arg19560X |
| | 9 | M | 49† | 47 | 32 | 50 | 1 | 49 | Septic Shock† | U | p.Trp976Arg |
| | 90 | F | 49 | NA | NA | NA | NA | | | I | p.Arg19560X |
| | 91 | F | 40 | 40 | 35.3 | 51 | 1 | | | I | p.Arg19560X |
| | 93 | M | | 19 | | | 1 | | | I | pArg19560X |
| MDD | 22 | F | 73 | 57 | 18 | 58 | 2 | | EF = 20% ICD(70) | A | p.Asp14909 |
| | 21 | M | 31† | 31 | | | | | CHF | A | NA |
| | 23 | F | 72 | 58 | | | | | EF = 20% | A | NA(+) |
| | 231 | M | 45 | 45 | | | | | AF(39) | I | + |
| | 2311 | M | 18 | 18 | 35.7 | 56 | 1 | | AF(16) | I | + |
| | 2312 | M | 16 | 16 | 33.3 | 48 | | | NSR | I | - |
| MEK | 111 | M | 24† | 17 | 17 | 77 | 4 | 15, 24 | Tx(15) | A | p.Pro22582fs |
| | 1 | F | 72 | 50 | 34 | 50 | NA | | STTWA; Q-waves, CHF | A | + |
| | 11 | M | 41† | 25 | 8 | 75 | 4 | 36 | 1AVB, LAFB, TWA Tx(36) | A | + |
| | 110 | F | 43 | NA | NA | NA | NA | | | U | - |
| | 112 | F | 19 | NA | NA | NA | NA | | | I | + |
| | 12 | M | 33† | 30 | NA | NA | 4 | 33 | CHF(33) | A | NA |

TABLE 14-continued

Clinical findings in DCM families with TTN truncating mutations*

| Pedigree | ID | Sex | Current age (yr) or death† | Age at diagnosis (yr) | FS (%)‡ | LVEDD (mm)‡ | NYHA class¶ | Age of VAD/Tx/Death (yr)^ | Comment☐ | Clinical Status | TTN Genotype(s)☐ |
|---|---|---|---|---|---|---|---|---|---|---|---|
| MEQ | 132 | M | 25 | 22 | 19.3 | 57 | 1 | | SB, EF = 45% | A | p.Pro13298_Thr17642dup |
| | 12 | M | 56 | 33 | NA | NA | 4 | 50 | NSVT, CHF(49) Tx(50) | A | NA |
| | 13 | M | 46† | 41 | NA | NA | NA | 42 | SCD(46) | A | NA(+) |
| | 131 | M | 33 | 33 | 38.8 | 54 | | | | I | − |
| MEW | 11 | M | 37 | 20 | NA | 50 | 4 | 31 | EF = 25% Tx(30) | A | p.Arg18985X |
| | 1 | M | 63 | 62 | NA | NA | 4 | 43 | Tx(43) | A | NA(+) |
| | 21 | M | 32 | 23 | NA | NA | NA | | ICD | A | + |
| MHG | 23 | M | 52 | 31 | 14.3 | 77 | 4 | 52 | AF, EF = 29% ICD(46) | A | p.Ala22353fs |
| | 1 | F | 57† | NA | NA | NA | NA | 58 | Lung Ca | U | NA |
| | 12 | M | 65 | 62 | 43.2 | 44 | 1 | | SB | U | − |
| | 15 | F | 57 | 41 | 32.8 | 61 | 2 | | Morbid Obesity Type II DM, PCM | I | − |
| | 152 | F | 27 | 27 | 50 | 46 | | | | I | − |
| | 2 | F | 66† | 59 | NA | NA | | 66 | CHF | A | NA(+) |
| | 21 | F | 63 | 48 | 31.9 | 38.3 | 2 | | LBBB, ICD | A | + |
| | 211 | M | 41 | 37 | 28.2 | 44.7 | | | | I | + |
| | 212 | M | 41 | 37 | 32.8 | 45.4 | | | | I | + |
| | 22 | F | 61 | 42 | 30.1 | 55.2 | 2 | | 1AVB, LBBB EF = 22% | A | + |
| | 221 | F | 35 | 32 | 30.1 | 52.2 | 1 | | NSR | I | + |
| | 222 | M | 32 | 29 | | | | | NSR | I | − |
| | 231 | M | 33 | 33 | | | | | NSR | I | − |
| | 3 | F | 25† | | | | | | Leukemia† | I | NA |
| | 31 | M | 52 | 52 | 46.4 | 48.1 | 1 | | IVCD | U | − |
| | 311 | F | 28 | 28 | 38 | 47 | 1 | | | I | − |
| | 4 | F | 55† | 50 | NA | NA | NA | 54 | CHF | A | NA(+) |
| | 41 | F | 56 | NA | NA | NA | NA | | | I | − |
| | 43 | F | 50 | 46 | 12.2 | 57.3 | 3 | | NSVT, STTWA ICD(50) | A | |
| | 46 | F | 48 | 48 | 32 | 50 | 1 | | | I | − |
| | 47 | M | 42 | NA | 26 | 53.5 | 1 | | NSR | A | + |
| | 48 | M | 42 | 43 | 16.7 | 72 | NA | | ICD(42) | A | NA |
| | 6 | M | 41† | 37 | NA | NA | 3 | 41 | NSVT, CHF(37) | A | NA |
| | 61 | M | 49 | 49 | 30.5 | 40.6 | NA | | NSR | U | − |
| | 62 | F | 47 | 47 | 41.7 | 34.3 | NA | | TWA | U | − |
| | 63 | F | 45 | 45 | 24.7 | 38.1 | NA | | TWA | I | − |
| | 64 | M | 42 | NA | 38.1 | 40.4 | NA | | NSR | U | − |
| | 7 | M | 61† | 56 | NA | 68 | NA | 61 | ST, CHF | A | NA(+) |
| | 70 | F | 65 | NA | NA | NA | NA | | | U | − |
| | 71 | F | 45 | 45 | 34.9 | 47 | 1 | | NSR | U | − |
| | 72 | M | 44 | 44 | 30.9 | 57.2 | 1 | | NSR | A | + |
| | 73 | F | 43 | NA | 36.3 | 38.6 | 1 | | SB, long QTc, TWA | I | − |
| | 74 | M | 42 | NA | 19.2 | 49.9 | NA | | SB | I | + |
| | 8 | F | 63† | 59 | NA | NA | 2 | 63 | Long QTc, TWA, CHF Nl Cors | A | + |
| | 82 | M | 40 | 31 | 9.6 | 55.3 | 2 | | LVH, LAFB, TWA | A | + |
| | 83 | F | 42 | 38 | 43.2 | 45.5 | 2 | | | I | + |
| | 84 | F | 48 | 44 | 40.6 | 43.3 | 2 | | SB, TWA | I | + |
| | 9 | F | 66 | 62 | 41.6 | 39.9 | 1 | | NSR | U | − |
| | 98 | M | 53† | NA | NA | NA | NA | 53 | SCD(53) | I | NA |
| | 981 | F | 42 | 39 | 33 | 43 | | | | U | − |
| | 99 | F | 59 | 56 | 33.8 | 41.7 | 1 | | PVC, MR | I | + |
| MHQ | 12 | M | 42 | 38 | 9.7 | 72 | 3 | | EF = 17.5% CHF, NSR | A | p.Gln30081X |

TABLE 14-continued

Clinical findings in DCM families with TTN truncating mutations*

| Pedigree | ID | Sex | Current age (yr) or death† | Age at diagnosis (yr) | FS (%)‡ | LVEDD (mm)‡ | NYHA class¶ | Age of VAD/Tx/Death (yr)^ | Comment☐ | Clinical Status | TTN Genotype(s)☐ |
|---|---|---|---|---|---|---|---|---|---|---|---|
| | 1 | F | 64 | 64 | 37.2 | 43 | 1 | | ICD(41) PAC | A | NA(+) |
| | 11 | F | 44 | 38 | 26.5 | 49 | 1 | | | U | − |
| MHX | 11 | M | 58† | 52 | 8.2 | 61 | 3.5 | | EF = 32.5% CHF, IVCD | A | p.Lys31371X |
| | 1 | M | 59† | 50 | NA | NA | | | DCM CHF | A | NA(+) |
| | 10 | F | 90 | 90 | | | | | | U | − |
| | 12 | F | 59 | NA | 41.3 | 46 | 1 | | TWA | U | − |
| | 13 | M | 51 | 50 | 27 | 63 | NA | | PVC, LVH, RBBB, ICD(51) | A | + |
| | 14 | M | 53 | NA | 36 | 50 | NA | | NSR | U | − |
| | 15 | F | 61 | 54 | 40 | 48 | | | ICD(56) MRI:GdE | I | + |
| | 16 | M | 63 | | | | | | Nl Echo | U | − |
| | 17 | M | 61† | 56 | 34 | 58 | 4 | 61 | CHF SCD | A | NA |
| | 18 | F | 66 | 52 | NA | NA | NA | | CHF; ICD | A | NA |
| MID | 1 | M | 40 | 37 | 15.7 | 51 | 2 | | PVC, TWA, EF = 34% | A | p.Gln25689X |
| | 2 | M | 48 | 41 | 19.6 | 56 | 1 | | | A | + |
| | 21 | M | 19 | 19 | 25.5 | 55 | 1 | | JR | A | + |
| | 22 | M | 17 | NA | 38.3 | 60 | 1 | | | A | + |
| MIP | 13 | M | 41 | 33 | 16.5 | 51 | 2 | | EF = 25% CHF, NSVT, ICD(33) | A | p.Trp27147X |
| | 1 | M | 65 | 42 | 19.7 | 76 | 4 | 50 (Tx) | ST, 1AVB, ICD | A | + |
| | 11 | M | 45 | 44 | 9 | 64 | 2 | | STTWA, ICD | A | + |
| | 111 | M | 27 | 27 | | | 1 | | | I | − |
| | 112 | M | 15 | 15 | 27.1 | 48 | 1 | | NSR | I | + |
| | 113 | M | 12 | 12 | 33.3 | 48 | 1 | | LVH, long QTc | I | + |
| | 12 | F | 44 | 44 | 27.7 | 47 | 1 | | STTWA, PVC | I | + |
| | 121 | M | 19 | 19 | 34.6 | 52 | 1 | | NSR | I | − |
| | 122 | M | 18 | 18 | 30.8 | 52 | 1 | | NSR | I | − |
| | 123 | M | 16 | 16 | 38 | 50 | 1 | | NSR | I | − |
| | 131 | M | 10 | 10 | 45.2 | 42 | 1 | | NSR | I | + |
| | 132 | M | 7 | 7 | 43.6 | 39 | 1 | | NSR | I | − |
| | 14 | F | 40 | 40 | 40 | 50 | 1 | | NSR | U | − |
| | 141 | F | 14 | 14 | 30.2 | 43 | 1 | | NSR | I | − |
| | 142 | F | 10 | 10 | 37.8 | 45 | 1 | | NSR | I | − |
| | 2 | M | 60 | 60 | 32.1 | 53 | 1 | | IVCD | U | − |
| | 3 | M | 63 | 56 | 5.6 | 54 | 4 | | AF | A | + |
| MIS | 11 | F | 62† | 59 | 25.5 | 61 | 2 | 62 | EF = 20% AF, CHF CHF, ICD | A | p.Thr21135 |
| | 1 | F | 65† | 65 | | | | | | A | NA(+) |
| | 2 | F | 79 | 79 | | | | | | U | − |
| | 3 | F | 85 | 85 | | | | | | U | − |
| | 12 | M | 61 | 55 | 18 | 57 | 1 | | | A | + |
| | 13 | M | 59 | 59 | 19 | 48.9 | | | CAD/MI PCIX3 | I | − |
| | 132 | M | 35 | 35 | 28 | 51.6 | 1 | | | I | − |
| | 14 | M | 37† | 27 | 13 | 76 | 4 | | Tx(37) | A | NA |
| | 141 | M | 30 | 30 | 32.6 | 52 | 1 | | EF = 60% | I | − |
| | 142 | M | 29 | 29 | 27 | 46.7 | 2 | | Epilepsy | I | − |
| | 19 | M | 50 | | | | | | DCM reported | A | NA |
| MIV | 14 | M | 50 | 26 | 9.5 | 63 | 3 | 49 | EF = 20% CHF, AF, ICD(47) | A | p.Asp14909 |
| | 11 | M | 56 | 54 | 31.1 | 54.3 | 1 | | NSR, CAD | I | − |
| | 12 | F | 53 | 52 | 22.3 | 54.3 | 1 | | Long QTc, VT ablation X2 | A | + |

TABLE 14-continued

Clinical findings in DCM families with TTN truncating mutations*

| Pedigree | ID | Sex | Current age (yr) or death† | Age at diagnosis (yr) | FS (%)‡ | LVEDD (mm)‡ | NYHA class¶ | Age of VAD/Tx/Death (yr)^ | Comment☐ | Clinical Status | TTN Genotype(s)☐ |
|---|---|---|---|---|---|---|---|---|---|---|---|
| | 121 | M | 22 | 20 | 13 | 76 | 4 | | VAD(20) | A | + |
| | 13 | F | 52 | 52 | 34.2 | 44.7 | 1 | | NRS | U | − |
| | 16 | M | 43 | 43 | 25.8 | 53.5 | 1 | | NSVT, RV dilated (55 mm) | A | + |
| | 2 | F | 81 | 81 | 12.4 | 49.2 | 1 | | | A | + |
| | 21 | F | 51 | 51 | 35 | 53.2 | 1 | | AVR/MVR | I | + |
| | 23 | F | 48 | 48 | 33.3 | 55.5 | 1 | | NSR | I | − |
| | 24 | M | 46 | 46 | 34 | 54.5 | 1 | | | I | − |
| TSFDC002 | 23 | M | 57 | 43 | 10 | 72 | 1 | 57 | PVC, LAFB, EF = 29% | A | p.Arg29415X |
| | 116 | M | 51 | 42 | 8.6 | 70 | 1 | | TWA, LAFB | A | + |
| | 190 | F | 72 | 66 | 22.4 | 58 | 3 | | TWA, PVC, RBBB, LAFB | A | + |
| | 205 | F | 52 | 47 | NA | NA | 3 | | LAFB, ST | A | + |
| | 26 | F | 18 | 13 | 32 | 50 | 1 | | NSR, Abn LV wall motion, MR | I | + |
| TSFDC017 | 253-2 | M | 72 | 65 | 22 | 59 | 1 | | EF = 40% | A | p.Glu17715fs |
| | 318 | M | 54 | 34 | 15 | 75 | 2 | 54 | AF, EF = 17% | A | + |
| TSFDC033 | 434 | M | 40 | 19 | 10 | 72 | 4 | | AF, TWA, ICD EF = 24% | A | p.Asn30348fs |
| | 0173 | M | 35 | 26 | 16.2 | 68 | 1 | 35 | NSR | A | + |
| TSFDC050 | 115 | M | 53 | 35 | 13 | 70 | 3 | | NSR, ICD EF = 24% | A | p.Arg17470X |
| | 1 | M | 50 | 48 | NA | NA | 3 | 50 | | A | NA(+) |
| | 113 | F | 21 | 18 | 31 | 48 | 1 | | | I | − |
| | 114 | F | 61 | 40 | 10.3 | 68 | 2 | | 1AVB, TWA ICD | A | + |

*Pedigrees are provided in FIG. 5. Probands and the TTN truncating mutation are listed first among family members.
Footnotes for symbols (‡¶||) are defined in Table 11.
†Non-cardiac causes of death are indicated.
Clinical status is denoted: A, affected; U, unaffected; I, indeterminate.
☐TTN genotypes are +, mutation present; −, mutation absent; NA, genotype not available; NA(+), obligate carrier based on pedigree position, but genotype not available.
Abbreviations used are defined in Table 11. Additional abbreviations used to describe electrophysiology are: NSR, normal sinus rhythm, LVH, electrocardiographic criteria for left ventricular hypertrophy; ST, sinus tachycardia; SB, sinus bradycardia; Q, Q waves; STTWA, ST and T-wave abnormality; TWA: T-wave abnormality; 1AVB, first degree atrioventricular block; LAFB, left anterior fasicular block; IVCD, intraventricular conduction delay; JR, junctional rhythm; RBB, right bundle branch block; LBBB, left bundle block; VT, ventricular tachycardia; PAC, premature atrial contractions; PVC, premature ventricular contractions; long QTc, prolonged corrected QT interval. Additional abbreviations to denote clinical findings are: Abn LV wall motion; abnormal left ventricular wall motion identified by echocardiography; CAD/MI, coronary artery disease/myocardial infarction; Diastolic Dysfunction, physician reported abnormal LV relaxation parameters; DM, diabetes mellitus; EF, ejection fraction; PCI, percutaneous coronary intervention SCD, sudden cardiac death; MRI:GdE, LV fibrosis identified by gadolinium enhance-MRI; RV, right ventricle; VT ablation, ventricular tachycardia treated by ablation.

TABLE 15

Likelihood of the odds (LOD) scores reflecting linkage between TTN mutation and DCM in individual families*

| Family | TTN variant | LOD score (pen = 0.95) | LOD score (pen = 0.80) |
|---|---|---|---|
| MEK | Frameshift | 0.29 | 0.29 |
| MEW | Nonsense | 0.17 | 0.17 |
| MHQ | Nonsense | 0.16 | 0.12 |
| MIP | Nonsense | 1.16 | 1.04 |
| MID | Nonsense | 0.59 | 0.59 |
| MHG | Frameshift | 3.57 | 3.21 |
| MEQ | Duplication | 0.00 | 0.00 |
| DNFDC081 | Nonsense | 0.17 | 0.17 |
| DNFDC088 | Nonsense | 0.84 | 0.84 |
| DNFDC103 | Nonsense | 0.17 | 0.17 |
| DNFDC142 | Nonsense | 0.00 | 0.00 |
| TSFDC002 | Nonsense | 0.59 | 0.59 |
| TSFDC017 | Frameshift | 0.00 | 0.00 |
| TSFDC033 | Frameshift | 0.17 | 0.17 |
| TSFDC050 | Nonsense | 0.30 | 0.30 |
| TSSDC019 | Nonsense | 0.00 | 0.00 |
| MHX | Nonsense | 1.14 | 0.96 |
| MDD | Splice | 0.17 | 0.17 |
| MIV | Splice | 1.47 | 1.40 |
| MIS | Splice | 0.14 | 0.09 |
| total | | 11.1 | 10.3 |

*LOD score for each family calculated at θ = 0 and indicated penetrance. Pedigrees and clinical data are provided in FIG. 5 and Table 15. See Methods for details on the assignment of affection status.

TABLE 16

Previously published TTN truncation mutations*

| AA position | NT name | AA name | Mutation Type | Genotype^ | Diagnosis | Source |
|---|---|---|---|---|---|---|
| 2484 | c.7450G > A | p.Gln2484X | nonsense | Hetero | Cancer | Greenman 2007[20] |
| 4053 | c.12156C > T | p.Gln4053X | nonsense | Hetero | Heart failure | Itoh-Satoh 2002 |
| 15465 | c.46395C > T | p.Trp15465X | nonsense | Somatic | Cancer | Greenman 2007[20] |
| 15700 | c.47098G > A | p.Arg15700X | nonsense | Somatic | Cancer | Greenman 2007[20] |
| 21924 | c.65766_65767insAT | p.Thr21924fs | frameshift | Hetero | DCM | Gerull 2002[1] |
| 28388 | c.85161delG | p.Glu28388fs | frameshift | Hetero | DCM | Gerull 2006[21] |
| 33534 | c.100600_100600 delACCAAGTG | p.His33534fs | frameshift | Homo | Congenital Myopathy | Carmignac 2007[22] |
| 33915 | c.101744delA | p.Lys33915fs | frameshift | Homo | Congenital Myopathy | Carmignac 2007[22] |
| 34242 | c.102723delT | p.Ser34242fs | frameshift | Hetero | Severe tibial muscular dystrophy | Hackman 2008[23] |
| 34322 | c.102965delA | p.Lys34322fs | frameshift | Hetero | Severe tibial muscular dystrophy | Hackman 2008[23] |
| 34323 | c.102967G > A | p.Gln4322X | nonsense | Hetero | Severe tibial muscular dystrophy | Hackman 2008[23] |

*Positions are for UniProt titin (Q8WZ42);
^Subjects are reported to have germline (hetero, heterozygous or homo, homozygous) or somatic TTN mutations.

TABLE 17

TTN exons comprising the standard UniProt titin protein (Q8WZ42) that have minimal or no evidence for cardiac expression

| Chrom | hg19 start | hg19 end | Q8WZ42 start | Q8WZ42 end |
|---|---|---|---|---|
| 2 | 179,535,817 | 179,537,208 | 11245 | 11396 |
| 2 | 179,540,648 | 179,542,644 | 11029 | 11139 |
| 2 | 179,544,066 | 179,545,898 | 10766 | 10931 |
| 2 | 179,549,057 | 179,549,716 | 10507 | 10591 |

All patents and other publications identified in the specification and examples are expressly incorporated herein by reference for all purposes. These publications are provided solely for their disclosure prior to the filing date of the present application. Nothing in this regard should be construed as an admission that the inventors are not entitled to antedate such disclosure by virtue of prior invention or for any other reason. All statements as to the date or representation as to the contents of these documents is based on the information available to the applicants and does not constitute any admission as to the correctness of the dates or contents of these documents.

Although preferred embodiments have been depicted and described in detail herein, it will be apparent to those skilled in the relevant art that various modifications, additions, substitutions, and the like can be made without departing from the spirit of the invention and these are therefore considered to be within the scope of the invention as defined in the claims which follow. Further, to the extent not already indicated, it will be understood by those of ordinary skill in the art that any one of the various embodiments herein described and illustrated can be further modified to incorporate features shown in any of the other embodiments disclosed herein.

SEQUENCE LISTING (727 sequences)

SEQ ID NO: 1 - DNA, 104301 bp, Homo sapiens
gagcagtcgtgcattcccagcctcgcctcgggtgtagggattgcatagaaaagcaaaactacacagtcttgactgtgtagttttgtttttaggattagaggctcaccgattcatgtcggagatggtcagaaaaaccaactctccataggacgtcgtttcagaagcaaccttgggcttagtcccaccctttttaggcactcttgagaaatcagagtgcctagaaagatgacaactcaagcaccgacgtttacgcagccgttacaaagcgttgtggtactggagggtagtaccgcaacctttgaggctcacattagtggttttccagttcctgaggtgagctggtttagggatggccaggtgatttccacttccactctgcccggcgtgcagatctcctttagcgatggccgcgctaaactgacgatccccgccgtgactaaagccaacagtggacgatattccctgaaagccaccaatggatctggacaagcgactagtactgctgagcttctcgtgaaagctgagacagcaccacccaacttcgttcaacgactgcagagcatgaccgtgagacaaggaagccaagtgagactccaagtgagagtgactggaatccctacacctgtggtgaagttctaccgggatggagccgaaatccagagctcccttgatttccaaatttcacaagaaggcgacctctacagcttactgattgcagaagcataccctgaggactcagggacctattcagtaaatgccaccaatagcgttggaagagctacttcgactgctgaattactggttcaaggtgaagaagaagtacctgctaaaaagacaaagacaattgtttcgactgctcagatctcagaatcaagacaaacccgaattgaaaagaagattgaagcccactttgatgccagatcaattgcaacagttgagatggtcatagatggtgccgctgggcaacagctgccacataaaacacctcccaggattcctccgaagccaaagtcaagatccccaacaccaccgtctattgctgccaaagcacagctggctcggcagcagtccccatcgcccataagacactccccttccccggtcagacacgtgcgggcaccgaccccatctccggtcaggtccgtgtctccagcagcaagaatctccacatcccccatcaggtctgttaggtctccattgctcatgcgtaagactcaggcatccaccgtggccacaggtcctgaagtgcctcccccttggaagcaagagggctacgtggcctcctcatctgaggctgagatgagagagacaacgctgacaacctctactcagatcaggacagaagagagatgggaagggagatacggtgtccaggagcaagtgaccatcagtggtgctgcgggtgctgccgccagtgtgtcggccagtgctagctacgcagcagaggctgttgccactggtgctaaagaggtgaaacaagatgctgacaaaagtgcagctgttgcgactgttgttgctgccgttgatatggccagagtgagagaaccagtgatcagcgctgtagagcagactgctcagaggacaaccacgactgctgtgcacatccaacctgctcaagaacaggtaagaaaggaagcggagaagactgctgtaactaaggtagtagtggccgccgataaagccaaggaacaagaattaaaatcaagaaccaaagaagtaattaccacaaagcaagagcagatgcacgtaactcatgagcagataagaaaagaaactgaaaaaacatttgtaccaaaggtagtaatttccgcagctaaagccaaagaacaagaaactagaatttctgaagaaattactaagaaacagaaacaagtaactcaagaagcaataagacaggaaactgagataactgctgcatccatggtggtagttgccactgcaaagtccacaaaactagaaacagtcccgggagctcaagaagaaactaccacacaacaagatcaaatgcacctaagttatgaaaagataatgaaggaaactaggaaaacagttgtacctaaagtcatagttgccacacccaaagtcaaagaacaagatttagtatcaagaggtagagaaggcattactaccaaaagagaacaagtgcaaataactcaggagaagatgagaaaggaagccgagaaaactgccttgtctacaatagcagttgctactgctaaagccaaagaacaagaaacaatactgagaactagagaaactatggctactagacaagaacaaatccaagttacccatggaaaggtggacgttggaaaaaaggctgaagctgtagcaacagttgttgctgcagtagaccaggcccgagtcagagagcccagagagcctgggcatcttgaagaatcctatgctcagcagaccactttggagtacggatataaggaacgcatttccgccgcaaaggtagctgagcctccccaacgtccagcctcagaaccccacgttgtccctaaagcagtcaagcctagagtaatccaggctccttctgagactcatatcaaaactactgatcaaaagggaatgcacatatcatcacagatcaagaaaactacagatctaacaacggaaagattagtccatgtggataaacgcccccgcacagctagccctcactttactgtttcaaaaatttctgttcctaagacagaacatggatatgaggcatcaatagccggtagtgctattgccacattacaaaaagagttgtcagccacatcttctgctcagaagatcaccaaatcggtgaaggctcctactgtgaagcccagtgagactagagtaagggcagagcccacacccttgccacagttccccttcgctgacacaccagatacttacaagagtgaagctggcgttgaggtgaaaaaggaagtaggggtgagcatcactggcaccaccgtccgtgaagagcgctttgaagtactgcacggacgcgaagccaaggtaacagaaacagcaagagtaccagcacctgttgaaattcctgttactccaccaactttggtctcgggcttaaaaaatgtgactgtcatagaaggtgaatctgtcaccttggagtgccacatctctggatacccatccccgacagtgacatggtacagggaagactaccaaatcgaaagttccattgacttccagataaccttccagagtggaattgctcgtcttatgattcgcgaagcatttgcggaagacagcgggcgatttacttgcagtgctgtaaatgaggctggaaccgtcagcacatcctgctatctggctgtgcaggtgtcagaagaatttgaaaaggaaaccacagccgtgactgagaaatttactacagaagagaaacgctttgttgagtcaagagatgtggttatgactgatactagcctcacagaggaacaagcagggcctggagaacctgccgcgccttactttattacaaaaccagtggtccagaaactggtggaaggtgggagcgtggtgtttggatgccaagttggcggcaacccaaagccccatgtatactggaaaaaatctggtgttcctctaaccactggatacagatacaaagtgagttacaacaaacaaaccggtgaatgcaagctggtgatttctatgacttttgctgatgatgctggagaatacactattgttgttcgcaataagcatggagaaacttctgcatctgcttccttgcttgaagaagctgattatgagttactgatgaagtcccagcaagaaatgctttatcagacacaagtgactgcatttgttcaagaacctaaagttggagaaacagcacctggatttgtatactctgagtatgaaaaagagtatgaaaaagaacaagccttaattaggaagaaaatggccaaagatactgtagtggtcagaacttatgtagaagatcaggaattccatatttcttcctttgaagagagacttattaaagaaattgaatatagaataataaagactacattagaagaacttcttgaagaagatggagaagaaaagatggcagttgacatttctgaatctgaagctgttgaatcaggatttgattcaagaatcaagaattatagaattcttgaggggatgggtgtcacttttcattgcaagatgtctggatatccattaccaaagattgcttggtacaaagatggcaagcgcatcaaacatggagaaagataccaaatggactttctacaagatggcagagctagtctgcgtatacctgttgttcttccagaagatgaaggaatctacactgcatttgccagcaatattaaaggaaatgcaatttgctcagggaaattgtatgtggagcctgctgcaccacttggagctccgacttacattcccacactagagccagtgagcagaatcagatctctctctccacgttcagtgagcaggtctcctatacgcatgtctcctgcacggatgtcacctgcaaggatgtctcctgcacggatgtcccctgcaagaatgtcccctggacgtaggctggaggagacagatgagtcacaacttgagagactatataaaccagtctttgtgttaaaacctgtttctttcaaatgtttagaagggcaaactgccagatttgacttaaaggttgttggtagacctatgccagagacgttctggtttcatgatggccagcaaattgtcaatgactatacccataaagtagtcattaaagaagatggtactcaatcactaattattgtccctgccacacccagtgattctggggaatggactgtggttgcccaaaacagggcaggcagatcttcaatttcagtgattttaactgtggaagctgtggaacatcaggtaaaaccgatgtttgtagaaaaactgaaaaatgtcaatataaaggaaggttcccgacttgaaatgaaagtcagagctacgggtaaccccaaccctgacattgtatggttgaaaaacagtgacatcattgtgcctcataaatatcccaaaatcagaattgaaggaaccaagggagaagctgcccttaaaatcgattccactgtcagccaagattctgcctggtatactgcgactgctattaataaagctggcagagacactacaagatgcaaagtaaatgttgaagttgagtttgcagagcctgagccagagagaaagttaatcatcccacgggggacatatagagcaaaggagattgcagccccagaactggagcccctccatttgcgatatggccaagagcaatgggaagaaggtgatctctatgacaaagagaaacaacagaaaccatttttcaagaaaaaactcacttccttaagacttaagcgctttgggcctgcccactttgaatgcaggctaacacccattggtgacccaacgatggtggtggagtggctccatgatggaaagccacttgaagcagccaacaggctccgtatgatcaatgaatttgggtactgcagccttgattatggcgttgcatattctagagacagtggtatcattacttgcagagccactaacaaatatggaacagatcacacatctgctacccttattgttaaagatgagaaaagtcttgtggaagaatcccaattgcctgaggggaggaaaggcttacagagaattgaagaattagagagaatggctcatgaaggtgcacttacaggtgtaacaacagatcagaaagaaaagcaaaagccagacattgtcttgtacccagagccagttagagtacttgaaggggagactgcaaggttccgctgcagggtaacaggctaccctcagcccaaagtcaactggtacctcaatggacagctcatccgcaaaagcaaaaggttcagagttcgctatgatggtatccattacctggacatcgtggactgcaaatcatatgacacaggtgaagtgaaggtcaccgcggaaaatcctgaaggtgtgatagagcataaagtgaagcttgagattcaacagagggaagattttaggtctgtccttaggagagctcctgaaccaaggcctgagtttcacgtacatgaaccaggaaagcttcagtttgaagtacaaaaagtggatagacctgttgacaccactgaaaccaaagaagttgtgaagttgaaaagggctgaaagaattacccatgaaaaagtgcctgaagagtcggaagagctgcgcagtaaattcaagcgcagaacagaagagggctattatgaagccattaccgctgtggagctcaagtctcgaaagaaggatgaatcctatgaggaactcctcaggaagacaaaagatgaacttctccactggaccaaagagttaactgaagaggaaaagaaagctcttgccgaagaaggcaaaatcacgattccaacttttaaacctgacaagattgaactaagtcctagtatggaggctccaaaaatcttcgaaagaatccagagccaaacagtgggccaaggatctgatgcacacttccgggtcagagtcgtggggaaaccagaccccgaatgtgaatggtacaaaaatggtgtcaaaattgaacggtctgaccggatctactggtactggcccgaagacaatgtttgtgaattggtcataagagatgtgactgctgaggactctgccagcatcatggtaaaagccatcaacatagctggagaaacctccagtcacgcattcttacttgtccaagccaagcaattgatcactttcacacaggaattacaagatgttgttgctaaggaaaaagacactatggcaacctttgaatgtgaaacttcagaaccatttgtcaaagtgaaatggtataaagatggtatggaggttcatgagggagataaatacaggatgcactctgacagaaaggttcacttcctctccatactgaccattgatacgtctgatgctgaagattacagctgtgtacttgtggaagatgaaaatgtcaaaacgactgctaaacttattgttgaaggtgcagttgttgagtttgtgaaagaacttcaggacatagaagttccagaatcatattcaggagaattagagtgcattgtatccccagaaaatatagaaggaaaatggtatcataatgatgtggagcttaaatccaatggcaaatatacaattacatctcgtcgtggacgtcagaacctcacggtcaaggatgtaaccaaggaggaccagggagaatacagctttgtcatcgacgggaaaaagacaacctgtaaattaaagatgaaaccccgccccattgctatcctacaaggacttagtgaccaaaaagtctgtgagggtgacattgttcagcttgaagttaaagtctccttggaaagtgtggaaggcgtctggatgaaagacggccaagaagtgcagcccagtgacagggttcacattgtgatagacaaacaatctcatatgctgctcattgaagacatgactaaggaagatgctggaaattactctttcaccattccagcccttggcctctccaccagtgggcgtgtctctgtctatagtgtggacgtgataacacctctaaaagatgttaatgtgattgaaggcaccaaggctgtgcttgaatgtaaggtgtcagtccctgatgtgacttctgttaagtggtacttaaatgatgaacaaatcaagcctgatgaccgtgtacaggccattgtgaaaggtactaaacagcgactagtcattaaccgaactcatgcttcagacgaaggaccttacaagctgatagttggcagagttgaaaccaactgtaatctctctgtagaaaaaattaaaattatcagaggtcttcgtgaccttacctgtacagaaactcaaaatgtggtgtttgaggttgagctgtcccactctggaattgatgtcctgtggaattttaaggacaaggaaatcaagcccagttctaaatataaaattgaagcacatggaaaaatatataaattgacagttctaaatatgatgaaagatgatgaaggaaaatacacattttacgcgggagaaaatatgacatctggaaaacttactgtggcaggtggggccatctccaagccactcacagatcagaccgtagctgaatcccaggaagctgtgtttgaatgtgaagttgccaacccagattccaaaggcgaatggttgagggatggcaaacacctaccactgactaacaacatcagaagtgagtctgatggccacaaaaggagacttatcattgctgccaccaaattagatgacattggagaatatacctacaaggtggccacctccaaaacatctgccaaactcaaagttgaagctgtcaaaattaagaagactctgaagaacctcacagtgacagaaacacaggatgctgttttcactgtcgagcttacacaccctaatgtcaaaggtgtccagtggatcaaaaatggagttgtgctggaatccaatgaaaagtatgctatctctgtcaaaggaacaatttactctctgaggattaaaaactgtgccatcgtggatgagtctgtttatggcttcaggcttggaaggcttggagccagtgccagactgcacgtggagactgtcaagatcattaaaaagccaaaggatgtgacagccttggaaaatgccactgttgcctttgaagttagtgtttcccatgacactgttccagtaaaatggttccataagagtgtggaaattaagccaagtgacaaacacagactggtctcagaaaggaaagtccacaagctgatgctgcagaacatctccccctcagatgctggggaatacacagctgtggtcgggcaattggaatgcaaagcaaaactgtttgtggagacattacatattacaaaaaccatgaaaaatatcgaggtgcctgagaccaaaactgcctcttttgagtgtgaggtgtcccacttcaatgtcccttccatgtggctgaagaatggtgtggaaattgagatgagtgaaaagttcaagatagttgtgcagggaaaactccatcagctgatcatcatgaacaccagcacagaggactcggcagaatacacatttgtctgtggcaatgaccaagtcagtgccaccctgacagtcaccccaatcatgattacttccatgctgaaagacatcaacgctgaagaaaaagacactattacttttgaggtgacagtgaactatgaaggcatctcttacaaatggttaaagaatggtgtggaaatcaaatcaactgacaagtgccagatgagaaccaaaaagctcacacactcactgaacatcaggaatgttcactttggggatgctgctgactacacctttgtggctggaaaagcaacatcaacagccacactttatgtggaagctcgtcatatagaatttaggaaacacattaaggacattaaggtactggagaagaagcgagccatgtttgaatgtgaagtttctgaacctgacatcactgtacagtggatgaaagatgaccaggaactgcagatcacagacagaataaagattcagaaggagaaatatgtccaccgccttctgatcccatccacccggatgtctgatgctgggaagtacacagtggtggcaggaggcaacgtgtcaactgcaaaactctttgtagaaggcagagatgttcgcatccgaagtattaaaaaggaggttcaggtcattgagaaacagcgtgctgttgttgaatttgaggtcaatgaagacgatgttgatgcccactggtataaagatggcattgaaatcaatttccaagttcaagaacgacacaaatatgtagtggaaagaagaatccaccgaatgtttatctctgagaccagacagagcgatgcaggagaatacacctttgtggcaggaaggaacaggagttctgtcactctctatgtcaatgctcctgaaccgccccaagttctgcaggagctccagcctgtcactgtgcagtctggcaagcctgcccgcttctgtgccgtgatatccggaagaccacagcccaaaatttcctggtacaaggaagagcagctgctttccactggcttcaagtgcaaatttcttcatgatgggcaagaatacacgcttttgctaattgaagccttcccagaggatgcggcagtctatacctgtgaagccaagaatgactatggtgttgccacaacatcagcttcactctcagtggaagttccagaagttgtgtctcctgatcaggaaatgcctgtttatccacctgccatcatcaccccgcttcaggacactgtcacttctgaagggcagccagcccgttttcaatgccgggtttctggaacagatctaaaagtgtcgtggtacagcaaagacaagaaaatcaagccatctcggttctttagaatgactcaatttgaagacacttatcaactggaaattgccgaagcttatccagaagatgaaggaacttacacgtttgttgctagtaatgctgtaggccaagtatcaagcacagccaacctgagtctggaagctcctgaatcaattttgcatgagaggattgaacaagagattgagatggaaatgaaagagttttctagttcttttctgtctgccgaggaagaaggacttcatagcgccgaacttcaattatctaaaataaatgaaacacttgaacttttgtctgaatctccagtttacccaactaaatttgattccgaaaaggaaggcactggcccaattttcatcaaagaagtgtcaaatgctgatataagcatgggggatgtggctacactgtctgtaactgtcattggcatccccaaacctaaaattcagtggttctttaatggagtgctattaaccccttctgctgactacaaatttgtttttgacggtgatgatcatagcctgatcattctgttcaccaaattggaggatgagggagagtatacatgtatggccagtaatgactatggaaagacaatatgtagtgcctatctaaaaattaattccaaaggagagggtcacaaagacactgaaacagaatcagcagtggcaaaatctctggaaaagctgggaggtccttgtcctcctcacttccttaaggagttaaaaccaattcgctgtgctcaagggcttcctgccatctttgagtacacagtggttggagagcctgcccctactgttacatggttcaaagaaaacaagcagctttgcaccagtgtttattacactatcattcataaccctaatggctctggaactttcattgtcaatgaccctcagagggaagacagtggcctctatatctgtaaagcagagaatatgttgggtgagtccacctgtgcagcagagctgcttgtgcttctggaagacacagacatgactgataccccctgcaaagcaaagtccacaccagaggctcctgaggattttccacagacacccttaaagggtcccgcagttgaagcacttgactcagagcaggaaattgcaacgtttgtaaaagacaccattttgaaagctgctttaattacagaagaaaaccagcaactatcttatgagcatattgctaaagccaatgaattgagcagtcagcttcctttgggagctcaggaattgcaatccattttggagcaagacaagctcactcctgaaagcaccagggaatttctttgcatcaatggcagtattcactttcagcctctcaaggaaccatctcccaacctacagctgcagattgtacagtcccagaaaaccttctccaaagaaggtattctaatgcctgaagagcctgagacacaggcagttctatcagataccgagaaaatcttcccaagtgccatgtccatagaacaaattaattcattaacagttgagcctctgaaaactttattagctgaacctgaagggaattatccacagtcttcaatagaacctccaatgcattcttatctaacctctgtggctgaggaagtactttcaccaaaagaaaagacagtatctgacaccaacagagagcaaagagtgactcttcaaaagcaagaggcacaaagtgcgctcatcttgagtcagagcttagctgagggacacgtggagagtctccagagtcctgatgtcatgatctctcaggtaaactatgagcccctagtcccttcagaacactcatgcacagaaggaggtaaaattttgatagaaagtgcaaatccactggaaaatgcagggcaagattctgcggtcagaattgaggaaggcaagtccttaagatttccactagcacttgaagaaaagcaggtactgctcaaagaagagcattctgacaacgtggtgatgcccccagaccaaatcattgagtctaaaagagagcccgtggcaataaagaaagtgcaggaggtacagggaagggaccttctttctaaggaaagcttgctttctggtattccagaagagcagagattaaacctgaaaattcaaatctgccgggctttgcaagcagccgtggccagcgagcagccaggtcttttctctgagtggctaagaaatattgaaaaggtggaggtcgaggctgtaaacatcacccaagagcccagacacatcatgtgcatgtaccttgttacttcggcaaagtctgtaacagaagaagtaaccatcattattgaagatgttgatcctcaaatggctaacctgaaaatggaacttagggatgctttgtgtgctattatatatgaggaaatagacatcctaacagctgagggtcctagaattcagcaaggagccaaaacaagtttgcaagaagaaatggattctttttcaggttcacagaaggttgaacccattactgaaccagaagttgaatctaaatatctgatctcaactgaagaggtcagttattttaacgtgcaaagtagggttaaatatttggatgccacacctgtcactaaaggggttgcttcagctgttgtctctgacgaaaaacaagatgagagtctgaaaccatcagaggaaaaagaggagtcttcctctgaaagtggtactgaggaggttgctacagtaaagatacaggaagctgagggtggcttaatcaaagaggatggccccatgatacatacacctttagtggacactgtttctgaggaaggtgatattgtacacctcacaacatccataacaaatgctaaagaggtgaattggtattttgagaataaactggtgccttcagatgaaaagttcaagtgtttacaagatcaaaatacatatacgctagtcatcgacaaagtaaataccgaagaccatcaaggagagtatgtctgtgaggccttgaatgacagcggaaaaacagcaacttcagccaaactcactgtagtaaaaagagctgccccagtgatcaagaggaaaatcgaacccctggaagtagcactgggccacctagccaaattcacctgtgagatccaaagtgctcccaatgtccggttccagtggtttaaagctggccgagaaatttatgagagtgacaagtgttctattcgatcttcaaagtatatctccagccttgaaatcctgagaacccaggtggttgactgcggcgagtatacatgcaaagcttccaatgagtatggcagtgtcagctgtacagccacactaactgtgacagaggcatatccaccaacctttctctccagacctaagtcccttacaacttttgtgggtaaggcagccaagttcatctgcacagtgacagggactcctgtgatagaaaccatttggcagaaagatggtgctgcactctcaccttcacctaactggaggatttccgacgcagaaaacaaacacattttagaactctcaaaccttaccattcaagatagaggagtttattcttgtaaggcttccaacaagtttggagcagacatctgccaagcagagttgatcatcattgataagccacatttcattaaagaattagagcctgtgcagtccgctatcaataagaaggtccaccttgagtgccaagtagatgaagacagaaaagtcacagttacgtggagcaaagatgggcaaaaactccccccagggaaagattataagatctgttttgaagataaaatagcaacacttgagattcctttggccaaactgaaagattcaggaacctatgtctgtacagcttcaaatgaggctggaagcagctcctgctcagccacagtcactgtcagagagccaccatccttcgtgaagaaggtggatccctcttatttaatgctcccaggtgaatcagcacgcctccattgcaagctgaaaggctcacctgtgatccaggttacttggtttaaaaataacaaagaactcagtgaaagtaacacagtccgaatgtattttgtcaattctgaggctatacttgatattacggatgtaaaagttgaagacagtgggagttactcatgtgaagcagtgaatgacgtcggcagtgatagctgcagtactgaaatagttatcaaagaacctccttctttcatcaaaactcttgagcctgcagacatagtgagaggaacaaatgctctacttcagtgtgaagtctcaggcactggaccatttgaaattagctggttcaaagacaagaaacaaattcgaagtagtaaaaaatacagattgttttctcagaagtctcttgtgtgtctggagatcttttcgtttaatagtgcagatgttggtgaatatgaatgtgttgttgctaatgaagtcggcaagtgtggctgcatggcaacccacttactcaaagaacctccaacctttgtaaagaaagtagatgatttgattgcactaggaggacaaaccgttaccctgcaagctgctgtgagagggtcagagcccatttctgtcacatggatgaaaggtcaagaggtcatcagagaagacggaaaaatcaaaatgagcttttccaatggtgttgcagtcttgataatccctgatgttcagattagttttggaggcaaatacacgtgcctggctgaaaatgaagctggaagccaaacatctgttggggaattaatagttaaagaacctgccaaaatcattgagcgagcagaactgatccaggtgacagcaggagatcccgccacactggagtacacagtggcaggcacgccagaactgaagcccaaatggtacaaagatgggagacccttggtcgccagtaaaaaataccgaataagttttaaaaacaatgttgcccagctcaaattttattcagctgagctgcacgacagtggccaatacacatttgagatttccaatgaagtgggcagcagctcctgtgagactacattcactgtattagatcgagacattgctccattttttaccaaacccttgcgcaacgtggatagtgttgttaatggtacctgcagactggactgcaaaattgcaggctccctccccatgagggtgtcctggtttaaggatggcaaagaaatagctgcttctgacagatacaggatagcatttgtggaaggcacagcctctttggagatcatcagagtagacatgaatgatgcagggaatttcacttgtcgagccacaaattccgtgggaagcaaagacagcagtggagccctgattgtgcaagaaccacccagttttgtaactaaacccggctcaaaggatgttctgcctggctcagcagtctgcctgaagagcactttccaaggatctactcctctcacaatcagatggtttaagggcaacaaagagctggtttctggtggaagctgctatattaccaaagaagctttagagagttccctggaactctatttagtaaaaacctctgattcgggcacgtacacatgtaaagtcagcaatgtcgctggaggggtggaatgcagtgcaaacttgtttgtaaaagaacctgccacatttgttgaaaagttagagccatcacagctgttaaagaagggagatgccacccagctagcctgcaaagtaactggtacccctccaattaaaataacatggtttgcaaatgatagagaaattaaggagagcagcaaacacagaatgtcttttgtggagtctactgcagttctaagactgacagatgttggcatcgaagacagtggtgaatatatgtgtgaggcccaaaatgaggctggcagtgaccactgcagtagcattgtaatagtcaaagagtcaccttattttaccaaggaatttaagccaattgaagtcttaaaggagtacgatgtcatgttgctggctgaggtggcaggcactcctccctttgagatcacttggttcaaagataacacaatcctgcgaagtggtagaaagtataagactttcattcaggatcatctggttagcctgcagatcctcaagtttgtagctgcagatgctggcgaataccagtgtcgggtgaccaatgaggtgggcagcagcatctgcagtgccagggtgactttaagagaacccccatccttcataaagaagatcgagagtaccagctccctccggggaggcacagctgccttccaggccactctgaagggctccttgccaattacggtgacttggctaaaagacagcgatgaaatcactgaagacgataatataagaatgacctttgagaacaatgtggccagtttgtacctcagtggcattgaagtcaagcatgatgggaaatatgtctgtcaggccaaaaatgatgcaggaatacaaagatgttctgcattactctcagtaaaagaacctgcaacaatcaccgaggaagctgtgtctatagatgtcacccaaggagacccagccactttgcaggttaaattttcagggactaaggagattacagccaaatggtttaaagatggccaagaactgaccctgggctcaaaatataaaatcagtgtcactgatacagtctcaatactgaagattatttctacagaaaagaaagatagtggagaatatactttcgaggtccaaaatgatgttgggaggagcagctgcaaggctagaattaatgtattagatcttatcatacctccttcattcaccaaaaagctgaagaaaatggacagcattaaaggttctttcattgatttagaatgtatagtggctgggtcacatcccataagcatccagtggttcaaagatgaccaagaaatatcagctagtgaaaagtacaaattctcttttcatgacaatactgccttcttggaaatcagccagctggaaggtacagacagtgggacatacacttgttctgccacaaataaggcagggcacaaccaatgcagtgggcatctgacagtcaaagaacccccttactttgtggaaaagccacagtcacaagatgtcaatcccaacacaagggtacagttaaaggctcttgtgggtggcactgcacccatgacaataaagtggtttaaagataacaaagagttacactcaggagcagcccgctcagtttggaaggatgacacctctaccagtctagagctctttgcagccaaagctaccgattctggaacctacatttgccaactaagcaatgatgttggcacagcaaccagcaaagccactctctttgtaaaagaacctcctcaattcattaagaagcccagtccagtcttagtgctgaggaatggacagtcaacaacatttgaatgccaaataacaggcactcctaaaatccgagtgtcttggtatctagacgggaatgaaataacagccattcagaaacatggcatttccttcattgatggtttagccactttccagatttctggtgccagggtagaaaatagtgggacttatgtgtgtgaagctcgaaatgacgcaggcacggcgagctgcagcattgaactcaaagtgaaagaaccccccacctttatcagagagctgaagcctgtggaggtagtaaaatatagtgacgtggagctggagtgtgaagttacgggaacacctccgtttgaagtcacttggctgaagaataacagggaaattcgaagcagcaaaaaatacacattgaccgacagagtgtctgtgtttaacctccatataaccaagtgtgacccttcagacactggggaataccagtgcattgtatccaatgaaggcggcagctgctcatgcagtactagagttgccctgaaagaaccaccatcattcattaagaagatagaaaataccactactgttttgaaaagttctgccacctttcagagtaccgtggcaggttctcctcctatttctataacctggctaaaggatgatcagattcttgatgaagatgataatgtctatatttcatttgtggacagtgtggccacacttcaaatcagaagtgtggataatggacacagtgggagatatacctgtcaagccaagaatgagtcaggagttgagaggtgttatgctttccttttagtacaagaaccagctcaaatcgtagagaaagctaaatcagttgatgttacggagaaagatcccatgaccttggaatgtgttgtggctggaacaccagaactcaaagtgaaatggcttaaagacgggaaacaaatagttcccagtagatacttttcaatgagttttgaaaataacgtggccagttttagaattcagtcagtaatgaagcaggacagcggtcagtacactttcaaggtggaaaatgacttcggaagcagtagctgtgatgcctacttaagagtgctagatcaaaatattcctccatcattcaccaaaaaattaaccaaaatggataaagttctgggctcttctattcatatggagtgcaaggtgtctggttcacttcccattagtgctcagtggtttaaggatggaaaagaaatatctacaagtgcaaaatacagacttgtgtgccatgagagatctgtgtctctggaagttaataatctggaattagaagatactgcaaattacacatgcaaagtgtcaaatgtagcaggagatgatgcatgcagtggcatcttaactgtgaaagaaccaccaagcttcctagtgaaacctgggcgacagcaagccatacctgattctacagtggaatttaaggcaatactaaaaggaacaccaccatttaaaataaaatggtttaaggatgatgtggaacttgtctcaggtcctaaatgtttcattggcttggaagggtcgactagcttcttaaatctctactcagtggatgcttctaagactggacagtatacttgccatgttaccaatgatgttggtagcgactcttgtactacgatgttgcttgtgacagaaccaccaaagtttgtaaagaaattagaagcctccaaaattgtgaaagcaggtgactcttcacgacttgaatgcaagatagctggatccccagaaatcagagttgtgtggttccgaaatgaacatgaacttccagccagtgataagtacagaatgactttcattgactcagtggccgtcatacagatgaacaatctcagtactgaggacagtggagatttcatttgtgaggctcagaatcccgctggcagcacaagctgcagtaccaaggttatagtaaaagagccacctgtttttagcagcttccctcctatagtagaaacccttaaaaatgctgaagtcagtcttgaatgtgaactttcgggaacaccaccgtttgaggtggtatggtacaaagacaagcggcaactcagaagcagcaagaaatacaagattgcatccaaaaacttccacacaagtattcacattctcaatgtggacacttcagacatcggtgaataccactgcaaagcacagaatgaagtgggaagtgatacttgtgtttgtactgtaaaattgaaagaaccaccaagatttgtctccaaactgaacagcctcactgttgtagccggagagcctgctgaattacaagcatccatagaaggcgcccagcctatttttgtccagtggcttaaagagaaggaagaagtgattagagaaagtgaaaacatcaggattacatttgtggaaaatgttgcaactctacagtttgcaaaagcagagccagctaatgctggaaagtatatctgccaaatcaagaatgatggtggaatgagggagaacatggccacactgatggtcttagagcccgcagtcattgttgagaaggcaggaccgatgacggtgactgtaggagaaacgtgcactctggagtgtaaggtggctggcactccggaactctctgttgaatggtacaaggatggaaagctgttgaccagcagccaaaaacacaaatttagcttctacaacaaaatctcttccttaaggattctctcagttgaaaggcaagatgcaggcacatacactttccaggttcaaaataatgttgggaaaagcagctgcacagctgtggttgatgtttcagaccgagcagttcctccctctttcacacgaagactgaaaaatactggtggggtgttaggtgcttcttgcatcttggaatgcaaagtagctggatcatcacctatttcagttgcctggtttcatgagaaaaccaagattgtcagtggagcaaagtaccaaaccacattttcagataatgtctgcacattgcagttgaattctctggattcctcagatatgggcaattacacatgcgtggctgctaatgtcgctgggtctgatgaatgtcgtgcagtgctaactgtacaagaaccaccctcttttgtgaaagaacctgaacctttggaagtactaccaggcaaaaatgtaaccttcacaagcgttattagaggaacccctccattcaaagtcaactggttcagaggtgccagagaactagtgaaaggagaccggtgcaacatctattttgaagacactgtggcagaactggaattatttaatattgacatatctcagagtggggaatacacctgtgtggtttctaacaacgctggccaagcatcttgcactacccgtctctttgtgaaagaaccagctgcatttttgaagagattaagtgatcattctgtagaaccagggaagtccataattctggagagcacctacactggaacacttccaatttctgtcacttggaaaaaggatggttttaacataactacctctgaaaaatgtaacatagtcacaacagagaaaacttgtatcctggaaattctgaatagcacaaaaagagatgcagggcagtattcctgcgagattgaaaatgaggcaggaagggatgtttgtggagctctggtatctacattagaaccgccttattttgttacggaactggaacctctggaggcagcagttggagattcggtttctttacaatgccaagttgctgggacaccagaaattacagtgtcttggtacaaaggagataccaaattacggccaactcctgaatacaggacctactttacaaacaatgtggccacacttgtttttaataaagtgaacatcaatgacagtggagagtacacatgcaaagcagaaaatagtataggaactgcttcttctaagactgtgttcagaattcaagagcgccaactcccaccttcttttgcaagacaattaaaggacattgaacaaactgtggggttacctgttacactcacttgtcgattaaatggctctgcacccatccaagtgtgctggtatagagatggagtacttttaagagacgatgaaaatctacagacttcatttgtagataatgtggcaactttaaaaattttgcaaactgacttgagtcactctggccagtactcttgctcagcttccaacccacttggaacagcatcttctagtgctagactcacagcaagagaacccaagaaatctcccttctttgacatcaagcctgtatctatagatgttattgctggagaaagtgctgattttgagtgtcatgttactggtgctcaaccgatgcgaatcacttggtcaaaagataacaaggagatccgtcctggaggaaactatacaatcacatgtgtgggaaacactcctcatttgagaattcttaaagtaggcaaaggagactctggtcaatatacttgccaagcaaccaatgatgttggcaaagacatgtgctcagctcagctcagtgtaaaagaacctccaaagtttgttaagaaattagaagcttcaaaagttgcaaagcagggagaatccattcaactggaatgtaaaataagtggctccccagaaatcaaagtttcatggttccgaaatgacagcgaacttcatgaaagttggaaatacaacatgtcattcattaattctgtggcattgcttacgatcaatgaagctagtgctgaagacagcggggactacatttgtgaggctcataatggtgttggtgacgccagctgcagcacagcgttgacagtgaaagcacctcctgttttcacccagaagccttctccagtaggagctcttaaaggttctgatgtgattctccaatgtgaaatttcgggaactcccccatttgaagtagtatgggttaaagatcgaaagcaggttagaaacagcaagaaatttaaaatcacttcaaaacattttgatacaagtcttcatatccttaatcttgaagcctccgatgtcggggaatatcactgcaaagctactaatgaggtgggaagtgacacgtgttcttgctctgtcaagttcaaagaacctccacgattcgtgaaaaagctaagtgacacctcaacccttattggggatgctgttgagttacgggccatagtggagggcttccagccaatttctgttgtctggctgaaagatagaggtgaagtcatcagagagagtgaaaataccaggatttcattcattgataacattgcaaccctccagctggggagtccagaagcatctaattctggaaaatatatatgccaaatcaaaaacgatgctggaatgagagaatgctctgcagtcttgactgtactagaaccagcaagaatcatagagaagcccgaacccatgactgtcactactggaaatccttttgcattagagtgtgtagtgactggaacaccagaactctcagccaagtggttcaaagatggaagagaattgtctgcagacagcaaacatcacattacattcatcaataaagtggcttcccttaaaatcccctgtgccgaaatgagtgacaaaggattatatagctttgaagtgaaaaacagtgttggcaaaagtaactgcactgtatccgtccatgtttctgatcggattgtgcctccttccttcatccgcaagctgaaagacgtgaatgccatcctgggggcctcagttgttttggagtgccgagtctctggctcagccccgatttcagttggctggtttcaggatggaaatgagattgttagtgggcccaaatgtcagtccagcttttcggaaaacgtctgtactttgaatctgagcttgttggagccctccgacacaggcatatacacgtgtgtggctgccaatgtagctggttccgatgagtgctcagcagtcctgactgtgcaagaaccaccatcttttgaacaaacccctgattctgtggaagttttgcctggaatgagcctcacattcaccagtgtcatcagaggcacccctcctttcaaggtcaagtggtttaaaggcagcagggaactggtgcctggggagtcatgcaacatctctctggaagattttgtcacagaactggagttgtttgaggtgcagccattagaaagtggagactattcttgcctcgttacaaatgatgctggcagtgcttcctgtaccacacatctttttgtgaaagaaccagccacctttgtgaaaagattggctgatttcagtgttgagacaggaagccccatagttctcgaggccacatacactggcacacctccaatctcagtgagctggataaaggacgagtatcttatttcacaatctgagagatgcagtattactatgacagaaaaatctaccatactggaaattcttgagagcacaatagaggattatgcacagtacagctgcctgatagaaaatgaggctggtcaagatatctgtgaagctctggtgtctgtcttagaaccaccgtactttattgaacctctggaacatgtggaagcagtcattggagaacctgcaactttacagtgtaaagtggatggaactccagaaattagaatttcttggtataaagaacacacaaagctacgatcagctcctgcatataaaatgcaattcaaaaataacgttgcttccttagtaatcaacaaagtggatcacagtgatgtgggagagtattcatgcaaggcagacaacagtgtgggggcagtcgcttcttcagctgtgcttgttatcaaagcgcgcaaacttccacctttctttgcaagaaaactgaaagacgttcatgagactctaggcttcccagttgcatttgaatgccgcatcaatggctcagaacctcttcaagtgtcttggtacaaggatggggttcttttgaaagatgatgctaatttgcagacatcttttgttcataatgtagcaactcttcagattttacaaactgaccagagccacatagggcagtataattgctctgcttctaatcctcttgggactgcttcatccagtgccaagctcattctctcagagcatgaagtgcctcctttctttgatctaaagcctgtatcagtagatcttgctcttggagaaagtggtacttttaaatgtcatgtaactgggactgcaccaatcaaaatcacttgggccaaagataaccgagagattcgccctggaggcaactacaagatgactttggtagaaaatactgccactctgacagttctcaaagtaggcaaaggcgatgccgggcagtacacctgctatgcaagcaacatcgctggaaaagactcttgttctgctcagctgggtgtacaagaaccacccaggttcattaagaagctagaaccttcaagaattgtgaaacaggatgaattcacaaggtatgaatgcaaaatcggtgggtctccagaaatcaaagttttatggtataaggacgagactgaaattcaagagagcagtaaattcagaatgtcattcgttgactcggtggctgtgctggaaatgcacaatctcagtgttgaagacagtggagactacacctgtgaggcccacaatgcagcaggcagtgccagcagcagcacatccttaaaagttaaagaaccacccattttccgcaaaaagcctcatcctatagagacactgaaaggagctgatgttcaccttgaatgtgagcttcagggcactcccccatttcacgtttcttggtataaagacaagagagaacttaggagcggcaagaagtacaagataatgtctgagaacttcctaaccagtatccacatcctgaatgtcgatgctgcagacattggggaatatcagtgtaaagccacaaatgatgtgggaagcgacacttgcgttggttccatcgctctcaaagcaccaccaagatttgtgaagaagctcagtgacatatctactgtcgttggtaaagaagttcagctgcagactaccattgaaggcgctgaacccatttcagtggtgtggttcaaagataagggagaaatcgttagagaaagtgacaacatatggatttcttattcagaaaacattgcaaccttacagttttcaagagtggaaccagccaatgctggaaaatacacttgtcagatcaaaaacgatgctgggatgcaagagtgcttcgccacgctatccgttctcgagcctgcaacaattgtagaaaagccagaatccataaaagttaccacgggagacacctgtaccttggagtgtacagtagctggcacccctgaactcagtactaagtggtttaaggatggaaaagagctaacaagtgacaacaaatacaaaataagcttcttcaacaaagtatccggccttaagatcatcaatgtagcaccgagtgacagtggggtatacagttttgaggtgcagaaccctgttggcaaagacagctgcacagcttcattgcaggtttcagaccgaaccgttcctccttcattcacaagaaaattgaaagagacaaatggtctatccggctcctcagttgtaatggagtgtaaagtctatgggtcacctccaatctctgtctcctggttccatgaaggaaatgagatcagtagtggaaggaaataccagaccaccctgacagataatacttgtgctttaactgtgaacatgctggaagaatcagacagtggtgactacacatgtatagctactaatatggctggttctgatgaatgtagtgctcctttgactgtgagagaaccaccatcttttgttcagaaacctgatcccatggatgttttaactgggaccaatgtaactttcacaagtatcgtaaaaggaacacctcctttcagtgttagctggttcaaaggtagcagtgaactagtaccaggtgacagatgcaacgtgtctttggaggattcagttgctgaactggagttgttcgatgtagatacatcacaaagtggagaatatacttgcatagttagcaatgaagctggcaaggcttcttgtacaacacatctctacataaaagccccagccaaatttgtgaagaggctgaatgattacagcatagagaaaggaaaacccctgatcctagagggtacattcactggaactcctcccatttcggttacctggaagaaaaatggcataaatgtaactccttctcagaggtgtaatataactacgactgaaaaatcggcaatcctggaaattccaagtagcacagtagaggatgcaggacaatacaactgctacattgaaaatgcctctggaaaagattcctgttcagcacaaatactcatactagaaccaccgtattttgtcaagcagttggagccggttaaggtgtctgttggagattctgcctctctacaatgccagcttgctggaacccctgaaattggggtatcctggtataaaggagatacaaaattgagacccactacgacttacaaaatgcattttaggaataatgttgctacactggttttcaaccaggttgatattaatgatagtggagaatatatctgcaaagctgaaaacagcgtgggagaagtttctgcatcaactttccttaccgttcaagagcaaaaacttccaccatcattttctcgacaattgagagatgttcaagaaacagttggactgccagttgtttttgattgtgccataagtggatcagaacctatctccgtgtcttggtataaagacggcaagccattgaaagacagcccaaatgtacaaacatcatttttagacaatacagccacactcaatatttttaaaactgaccggagccttgcaggccagtattcctgcacagctacaaaccctataggctctgcttcttccagtgccaggctcattctcacagaggggaagaacccacccttctttgacatccgtcttgcccctgtggatgctgtggtgggagaaagtgctgactttgagtgccacgtcacgggcacacaaccgataaaggtcagctgggccaaagacagcagagaaatacgaagtggcggaaagtaccagattagttatctggaaaacagcgcccacctgacagtcctcaaagtagacaaaggagattctggacaatatacctgctatgctgtgaatgaagtgggaaaagactcttgcacagctcagctgaatataaaagagcggctcatcccaccaagtttcactaaaagactctcagagacagtagaagaaacagaagggaattctttcaaacttgagggacgtgtggctggttcccaacctataactgttgcctggtacaaaaataatatagagatacaaccaacttctaactgtgaaataacattcaagaacaacacgttagtgctgcaagtcaggaaagcaggcatgaacgacgctggtttgtacacatgcaaagtgtccaatgatgcaggctctgctctgtgcacgtcttcaatcgtcatcaaagaacctaagaagccacctgtatttgatcagcaccttactccagtaacagtgagtgaaggagaatacgtgcagctcagctgccatgtccagggatctgagccaattaggatccagtggttgaaggctggcagggaaataaagccttcagacagatgcagcttcagctttgctagtgggacagctgtactggaactcagagatgtggctaaagcagattcgggagattatgtgtgtaaagcttcaaatgtggctggaagtgacactaccaaatcaaaagtgaccattaaagacaaaccagctgtggccccagcaaccaagaaagctgcggtagatggaagactcttttttgtgtcagaacctcagagtatcagagtcgtagaaaaaaccactgcgaccttcattgcaaaagttggaggtgacccaatcccaaatgttaaatggacaaaagggaagtggagacagctgaaccaaggaggtcgtgttttcatccaccaaaaaggcgatgaagcaaaactggagattagggacaccacaaaaactgattctgggttataccgatgcgtggcatttaacgaacatggtgaaattgaaagtaatgttaacttacaggtggatgaaaggaagaaacaagagaaaattgaaggcgatcttagagcaatgctgaaaaagactccaatcttaaagaaaggagctggagaagaagaggaaattgatatcatggaacttctcaaaaatgttgatcctaaagaatatgaaaaatatgcccgcatgtatggaatcactgacttccgaggtcttcttcaagcatttgaactgctcaagcaaagccaagaagaagagacacatagactggaaattgaggaaatagagaggtcagagagggacgaaaaggaatttgaggaacttgtatcatttattcagcaaagactgtcacagacagagcctgtcactctgatcaaggacattgaaaatcagacagttttgaaagataatgatgctgtctttgaaattgacattaaaattaattatccagaaatcaagctttcgtggtacaaaggaactgaaaaactggaacccagtgataaatttgaaataagcattgatggtgaccgacatacactcagagtcaaaaactgtcaacttaaagaccagggcaattatcgattggtttgtggtccacacatcgctagcgctaaactaactgtaattgagcctgcatgggaacggcatcttcaggatgtgactctgaaagaaggccagacttgcaccatgacatgccaattttctgtaccaaatgtaaaatctgaatggttcagaaatggcagaatccttaaaccccaaggtagacataaaacagaagtggaacacaaagtccataaattgaccattgcagatgttcgagcagaagaccagggtcagtacacctgcaaatatgaagaccttgaaacttcagcagaactcagaatcgaagctgaaccaattcagtttacaaagcgcatacagaacatcgtggtgagtgagcatcagtctgccacctttgagtgtgaagtgtcctttgatgatgccattgtaacatggtacaaaggaccaacagaactgacagagagccagaaatacaacttcaggaatgatggccgctgccattatatgaccatccacaatgtgaccccagacgatgaaggtgtctactcggtcatcgctcggctggagccaagaggtgaagcaagaagcacggcagagctgtacctaacgacgaaagaaatcaaacttgagctgaagcctcctgatattcctgactccagagttccaatcccaaccatgcctatcagagcagtgccaccagaagaaatccctcctgtggttgctcctcctatcccccttttgctaccaacacccgaagaaaagaaaccaccaccaaaacgtattgaagttaccaaaaaggctgtgaagaaagatgccaaaaaagttgttgcaaagcccaaagagatgacaccacgtgaagagattgtcaagaagcctccacctcctactaccttaattccagcaaaagctcctgaaatcattgatgtatcctctaaagctgaagaagtaaaaataatgactataaccagaaagaaagaggttcagaaagaaaaagaagctgtgtatgagaaaaagcaagcagtccacaaggagaagagagtcttcattgaatctttcgaagaaccttatgacgaactggaggtagaaccatacacagagccatttgaacaaccttattatgaagaaccagatgaagactatgaagagattaaggtagaagctaaaaaagaagttcacgaggaatgggaagaagattttgaagaagggcaagaatactatgaaagggaagaaggctatgacgaaggggaggaagagtgggaagaggcttaccaagaaagggaagtaattcaagttcaaaaggaggtctatgaagaatcacatgagagaaaagttccagccaaagtacctgaaaagaaagcaccaccacctcctaaagttataaagaagccagtaattgaaaaaattgaaaagacttctcgaagaatggaggaagaaaaagttcaagtcaccaaagtacctgaagtttcaaagaagattgttccacaaaaaccttcccggactccagtacaggaagaagttattgaagtgaaagtaccagctgtgcatacaaagaagatggttatttcagaagaaaagatgttctttgcttctcacacagaggaggaggtgtcagtcacagtccccgaggtacaaaaggaaattgttactgaagagaaaattcacgttgccatttccaaaagggttgaaccaccacctaaagtccctgagctacctgagaaaccagctccagaagaagtggcccctgttcctatccctaaaaaagtggagcccccagcaccaaaagttcctgaggttcccaagaaacccgtgccagaggagaaaaagccagttcctgtgcctaagaaggaacctgctgctcccccaaaagtcccagaggtgccaaagaaacctgtccctgaagaaaagattcccgttcctgttgcaaagaaaaaggaagctcccccagctaaagttcctgaagtacagaagggagttgtgacagaagaaaaaataaccattgtaactcaaagagaggaatctccaccaccagcagtgccagaaataccaaagaagaaagttcctgaagaaaggaaacctgttcctcggaaggaggaagaagttccaccaccaccaaaagtgccagctctgcctaagaaacccgtcccagaggagaaagttgcagtgccagttcctgtcgctaagaaagctcctcctccccgagctgaagtctctaagaaaactgttgtagaagaaaagagatttgttgctgaagaaaaactatccttcgcagttcctcaaagagtggaagtcacgcggcacgaagtatctgcagaggaggaatggagttactcagaagaggaggaaggtgtgtccatttcagtttatagagaagaagaaagagaggaggaggaagaagcagaggttacagaatatgaagtgatggaagagcctgaggaatatgttgtggaagaaaagctgcacattatttctaagagagtggaagctgagccagctgaagtgacagagaggcaggagaagaaaattgtactgaaaccaaaaattcctgctaaaatagaggagcctccaccggctaaagttcctgaagcacctaagaaaattgtgccagaaaagaaagttcctgctccagttcctaaaaaggaaaaggtgcccccacctaaagtgccagaagagccaaagaaaccagttccagaaaaaaaggttcctccaaaagtcattaagatggaagaacctctcccagccaaagtgactgagaggcacatgcaaattacccaggaagaaaaagttcttgttgctgtaactaaaaaagaggcgcctccaaaagcaagagtgccagaggaaccgaagagagctgtcccagaagaaaaagttctgaaactcaaacctaaaagagaggaggaaccaccagctaaagtgactgaattcagaaaaagagtggttaaagaagaaaaagtatcaattgaagctccaaaaagagaacctcaacccatcaaagaagtaactataatggaagagaaagaaagggcttataccctagaagaagaagctgtttcagtacaacgggaagaagaatatgaggaatatgaagaatatgattataaagaatttgaggagtatgaaccaacagaagaatatgaccaatatgaagaatacgaggagcgggagtatgaacgatatgaagagcatgaagaatacatcacagaaccagagaagcctatccctgtaaagcctgtcccagaagaaccagttcccacaaaaccaaaggccccaccggctaaagtgctgaagaaagctgtccctgaagaaaaagtaccagtgcccattcctaagaaactcaaacctccaccacccaaagtgcctgaagaaccaaagaaagtttttgaggaaaaaatacgtatttcaattaccaaacgtgaaaaagagcaggtgactgaacccgctgctaaagtgcccatgaagcccaagagggttgtcgcagaagaaaaagtacctgtccctagaaaagaagtagcaccacctgttagagtgccagaagtgcctaaagaacttgaaccagaagaggttgcctttgaagaggaagttgtaacccatgtagaagaatatcttgtagaagaagaagaagagtacattcatgaagaagaggagttcataactgaggaagaagtggtgccagtgataccagtcaaagtgcctgaggtacccaggaaacctgttccagaagagaagaaacctgttcctgttcccaagaagaaggaagctccaccggcaaaagtgcctgaggttcctaagaagccagaggagaaagttcctgtgcttattcctaaaaaggagaagcctccgccagcaaaagttcctgaagtgcccaagaaacctgtgccagaggagaaagtaccagtaccagttcctaaaaaggtggaagctccacctgccaaagtgccagaggtacccaagaagcctgtgcctgagaagaaggtgccagttcctgctcctaagaaagtggaggctccacctgcaaaagtgccagaggtgcccaagaagctcatcccagaagaaaagaaaccaacacctgttccgaaaaaagtggaagcaccaccacccaaagtgccaaagaaacgtgaaccagttccagttcctgtagctctacctcaggaagaggaagttctatttgaagaagaaattgttcctgaagaggaagttctacctgaggaagaggaagttctacctgaggaagaggaagttctacctgaagaagaggaagttctacctgaagaagaggaaattccacctgaggaagaggaagttcctcccgaagaagaatatgtacctgaggaagaagaatttgtacctgaagaagaagtccttccagaagttaaacctaaggtgccagtacctgcaccagtgcctgaaattaagaagaaagtgacagagaagaaagtggtcattcccaagaaagaggaggctccccctgccaaagttcctgaggtgcctaagaaggtggaagaaaaacgaatcattctccctaaagaagaggaagttctaccagttgaagtgactgaggagcctgaagaagagcctatttcagaagaagaaatcccagaagaaccacctagcatagaggaagttgaagaggtggcaccacctagagtgcctgaagtgattaagaaagcagtacctgaagcacctactcctgttcctaaaaaagtggaggcaccaccagctaaagtgtcaaagaaaattcctgaggaaaaagtacctgttcctgttcagaaaaaagaggcacccccagccaaagtgcctgaagtaccaaagaaagtcccagaaaagaaagtccttgtgcctaaaaaggaagctgttcccccagctaaagggagaactgtccttgaagaaaaagtatcagttgccttccgccaagaagtagtagtaaaagaaagactagaattagaagtagtagaagcagaagtggaagaaattccggaagaagaagagttccatgaagttgaagaatattttgaagaaggcgagtttcatgaagtagaagaattcatcaaattagaacaacatagagttgaagaagaacacagagttgaaaaagttcatagggtaatagaagtttttgaggctgaagaagtggaagtatttgaaaaaccaaaagctccacctaaagggcctgagatatctgagaaaatcatccctccaaaaaaaccgcccactaaagttgttcctcgaaaagagccaccagctaaagtaccggaggtgcctaagaaaattgtggtagaagaaaaagtacgtgttcctgaagagcccagagttccaccaactaaagtgcctgaagtgctgccaccgaaggaagtggtcccagaaaagaaagtaccggtgcctcctgccaaaaagccagaagctccacctcctaaagtgcctgaggctcccaaagaagttgttcctgaaaagaaagtgccagtgcctcctcctaaaaagcctgaagtgccacccacaaaagtcccagaggtgccaaaggcagctgtcccagaaaagaaggtgcctgaagctattcctcccaaaccggaaagtcctccccctgaagtgccagaggctccgaaagaagttgttcctgaaaagaaagtgccagcggctcctcctaaaaagcctgaagtcacacctgttaaagtgcctgaggctcccaaagaagttgttcctgaaaagaaagtgccagtgcctcctcctaaaaagcctgaagtgccacccacaaaagtcccagaggtgccaaaggtagctgtcccagaaaagaaggtgcctgaagctattcctcccaaaccggaaagtcctccccctgaagtgttcgaggagcctgaggaagttgccctagaagagcctcctgctgaagttgtggaagagccagagccagcggcgcctccacaagtgaccgtaccacctaagaaacctgtcccagaaaagaaagcacctgctgtcgttgccaaaaaacctgaactaccaccagtgaaagtgcccgaggtgcccaaggaggttgttcctgaaaagaaggtgcctctggtggttcccaaaaagccagaagccccacctgctaaagtgcctgaagttccaaaagaagttgttccagaaaagaaagtagctgttcccaaaaagccagaagtcccaccagcaaaagtgccagaagtgccaaagaaacctgtcttggaagagaaaccagctgttcctgttccagaaagagcggagtctcctcccccagaagtatatgaagaacctgaggaaattgctcctgaagaggaaattgctcctgaagaggaaaagccagttcctgttgcagaagaggaggaaccagaggttccacctccagcagtgcctgaagagcccaagaagatcatcccagagaagaaagttcctgtcatcaaaaaaccagaagcaccgcctcctaaagaacctgaacctgaaaaggttattgagaagccaaaactcaaaccaagacccccacctcctccacctgctccacctaaggaagatgtgaaggagaaaatattccaacttaaagctattccaaagaagaaagttcctgaaaaacctcaggttccagaaaaagtggagcttacacctctgaaagtgcctggaggtgaaaagaaagttcgcaaattacttccggaacgtaaacctgaaccaaaggaagaagttgttctgaaaagcgttctaagaaaaagacctgaagaagaagaacctaaagtagaacctaaaaaactagaaaaagttaaaaaacctgcagtaccagaaccaccacctccaaaacctgttgaagaggttgaagtacctactgttacaaaaagggaaaggaagattcctgaaccaacaaaagtgcctgaaatcaagccagcaatacctctccctgcacctgaaccgaaaccaaagcccgaagcagaagtgaaaacaatcaaaccacctcctgtggaacctgaaccaacccccatcgctgccccagtaacagtgccagtggttggaaagaaagcagaagccaaagcacctaaggaagaggctgccaagccaaaaggtcctatcaaaggtgtacccaaaaagactccttcaccaatagaagccgaaaggagaaagttaaggccaggaagtggtggagagaaacctcctgatgaagccccgttcacctaccagctaaaggctgtgccactgaagtttgtgaaagaaatcaaagacatcatcttgacagaatcagagttcgttggctcttcagcaatctttgaatgtttggtctccccttccactgcaattacaacctggatgaaagacggtagcaatatccgtgagagtcccaagcacaggtttattgcagatggtaaagacagaaagctgcacatcattgatgttcaactttccgatgctggtgaatacacctgtgttttacgtttgggaaacaaagaaaagacctccacggctaaacttgttgtagaagaacttcctgtgcgttttgtaaaaacactggaagaggaagtcacagtggtcaaaggacagccattgtacttgagctgcgagttaaacaaagagcgtgacgtggtctggaggaaggatggcaagattgtggtggagaaacctggccgaattgtgccaggcgtcattggcttgatgcgggctctgaccatcaacgatgcagatgacacagatgctggaacatacacagttactgtggaaaacgccaacaacctggagtgttcatcttgcgtaaaagtagtagaagtcattagagattggctggtgaaacctatacgagaccagcatgtgaaacccaaggggacagctatttttgcctgtgatatagcaaaagatactccaaacattaagtggttcaaaggatatgatgaaatccctgcggaaccaaatgataagactgaaatactgagagatggaaatcatctgtacctcaaaattaagaatgctatgccagaagatattgctgagtatgcagtggaaattgaaggaaaaagataccctgcaaagctgacacttggagagcgtgaagttgaactgcttaaaccaatagaggacgttaccatttatgagaaagaaagtgcaagctttgatgcagaaatctcagaggcagacattcctggacaatggaaactgaaaggagaacttctaaggccctcacctacttgtgaaatcaaagcagaaggtggaaaacgcttcttaactttgcacaaagtcaaactggaccaagctggtgaagtcctctaccaggcccttaatgcaattacaactgccattttgacagtaaaagaaatcgaacttgactttgctgtgcccctgaaggatgtcactgttccagaaaggcgacaggctcgattcgaatgtgtcctcacccgagaggcaaatgttatatggtccaaaggacctgatataattaagtcatctgacaaatttgatatcatcgctgatggaaagaaacatattcttgttattaatgattctcaatttgatgatgaaggggtctatactgctgaggtggagggcaagaagacctcagctcggttgtttgtcacaggtataagactgaaattcatgtcacctcttgaagatcaaacagtaaaagaaggtgaaacagcaacttttgtttgtgaactttctcatgaaaaaatgcatgtagtctggttcaaaaatgatgccaaactccatacaagcagaacagtactcatctcttctgagggcaagactcacaaattggaaatgaaagaagtgacattggatgatatatctcagataaaagctcaagtcaaggagctgagctccacagcacagctgaaggtcttagaggccgatccctacttcactgtgaaattacatgacaaaactgcagtggagaaggatgagattactttgaagtgtgaagtgagcaaagatgtaccagtgaaatggttcaaagatggtgaagagattgtcccttcacccaaatattctatcaaggcagatggcctgcgccgcatcttaaaaatcaaaaaggcggaccttaaagataaaggcgaatatgtgtgtgactgtggcacagacaagaccaaggcaaatgttactgttgaggctcgactaataaaagtggaaaagcctctgtacggagtagaggtgtttgttggtgaaacagcccactttgaaattgaactttctgaacctgatgttcacggccagtggaagctgaaaggacagcctttgacagcttcccctgactgtgaaatcattgaggatggaaagaagcatattctgatccttcataactgtcagctgggtatgacaggagaggtttccttccaggctgctaatgccaaatctgcagccaatctgaaagtgaaagaattgcctcttatcttcatcacacctctcagtgatgttaaagtcttcgagaaagatgaggctaagtttgagtgtgaagtatccagggagcccaaaacattccgttggctaaaaggaacccaggaaatcacaggtgatgacagatttgagcttataaaggatggcactaagcattcaatggtgatcaagtcagctgcttttgaagatgaagcaaaatacatgtttgaagctgaagataagcacacaagtggcaaactgatcattgaaggaatccggctcaaattcctcacccctctcaaagatgtaactgccaaagagaaggaaagtgctgtatttactgtggagttatctcatgataacatccgagttaaatggttcaagaatgaccagcgcctacacaccaccaggtcggtctcaatgcaagacgaagggaaaactcattcgatcacattcaaagacctgtctattgatgacacctcccaaattagagtagaagctatggggatgagttcagaagctaaactcactgtgcttgagggagacccatattttacaggaaaacttcaagattatactggtgtagagaaagatgaagttattctacagtgtgaaattagcaaagcagatgcaccagtgaaatggtttaaggatgggaaggaaataaagccatccaaaaatgctgttattaaggcagatggcaagaaacgcatgctaatcctaaagaaagccttgaaatcagatattggacagtacacctgtgactgtgggacagataagacctcaggaaaacttgacattgaggatcgggaaattaaactggtgcgacccctgcacagtgtggaggtgatggagactgagacagcacgctttgaaaccgaaatctctgaagatgatatccacgccaactggaaactcaagggagaggccctactccaaacacctgattgtgaaattaaggaagaaggcaaaatacactcccttgttttgcacaactgtcgcctggaccagacgggtggggtggatttccaagctgccaatgttaaatctagtgcccacctccgagttaagccacgagtaattggtcttctgaggcctttaaaggatgtcaccgtgactgcaggggaaacagccaccttcgactgcgagctctcctacgaagatatcccagtggaatggtatctcaaagggaagaaactagagcccagcgataaggtggtcccacgttcagaaggaaaagttcatacacttactctgagggatgtaaagttagaagatgctggggaagtccaactaacagcaaaagatttcaaaactcacgccaacctctttgtgaaagaacccccagttgaattcactaagcctcttgaggaccagacggtcgaagagggagccactgcagtgctggagtgtgaagtctccagagaaaatgctaaggtgaaatggttcaaaaatgggacagaaatcctcaaaagcaagaagtatgaaattgttgctgatggcagggtcagaaaacttgttatacatgactgtaccccagaggatattaaaacatacacttgtgatgctaaggattttaagacttcctgtaacctgaatgtcgtgcctcctcatgtggaattcttaagaccactcaccgaccttcaagttagagaaaaagaaatggctcgatttgagtgtgaactttcccgagaaaatgctaaggttaagtggtttaaagatggtgctgaaattaaaaagggcaaaaaatatgacatcatatccaagggagcagtgcgcattcttgtcatcaacaaatgtctactggatgatgaagctgaatattcctgtgaagtaaggacagcgagaacttctggcatgctgacagttctggaagaagaagctgtctttaccaaaaatcttgccaacattgaagttagtgaaacagacactataaaactggtttgtgaagtctccaaacctggcgcagaagtgatttggtataaaggggatgaggagatcattgaaacaggaagatatgaaatactgactgaaggacggaagagaatcctggtcattcagaacgctcaccttgaggatgctggcaactacaactgtcgactcccaagctctcgaaccgatggcaaagtcaaagtacatgaactggctgctgaatttatctcaaagcctcaaaaccttgaaatacttgaaggagaaaaggctgaatttgtctgctctatatcaaaagaaagctttccagtccagtggaagagggatgataagacacttgaatctggagataaatatgacgttattgctgatggtaaaaagagggtcctagttgtgaaagatgccacattacaagatatgggcacttacgttgtcatggtaggggccgccagagcagcagctcacttgacagtcattgaaaaactcaggatcgtagttcctcttaaggacacccgggtgaaggaacaacaggaagttgtcttcaactgtgaagtcaatactgaaggtgccaaagccaaatggttcagaaatgaagaagctatatttgatagttcaaaatacatcattctccaaaaagacctagtctacaccctcagaattagagatgcacacttagatgaccaagccaactataatgtgtctttgaccaatcacagaggtgaaaatgttaaaagtgcagccaatctaatagtagaagaggaagaccttaggattgttgagcctcttaaagatattgaaacaatggagaagaaatctgtcacattctggtgcaaggtgaatcgtctcaatgtaacactgaagtggaccaaaaatggtgaagaagtgccttttgacaaccgtgtctcatacagagttgataagtacaagcacatgttaaccattaaagactgtggcttcccagatgaaggtgaatacattgtcactgctggacaagataaatctgttgctgagcttctcatcatagaagccccgacagaatttgtggaacacttggaagatcagacagtcactgagttcgatgacgctgtcttctcctgccagctctccagagagaaagccaatgtaaaatggtacagaaatgggagagaaatcaaagaaggcaaaaaatacaaatttgaaaaagatggaagtatacacagactcattataaaagattgcaggctggatgatgagtgtgaatatgcttgcggggtagaagacaggaagtctcgtgctagactttttgtggaagaaattcctgttgagatcatcaggcctccacaagatattcttgaagcccctggtgctgatgttgtctttttagcagaactcaataaagataaggtggaagtccaatggctaagaaataacatggttgttgtccagggtgataaacaccagatgatgagtgaaggaaagatacatcgactacagatttgtgatattaagccccgtgaccagggtgaatacagatttattgccaaagacaaagaagccagagctaagcttgaactggcagctgcaccaaaaatcaagacagctgaccaagaccttgtggttgatgttggcaagcctctgacaatggtggtgccatatgatgcctaccccaaagcagaagctgaatggtttaaagaaaatgaacctttatctacaaaaaccattgatactacggctgaacaaacttctttcagaattttagaagccaagaaaggagacaaagggaggtataaaattgtgcttcagaacaaacatggaaaagcagaaggattcatcaatttaaaagttattgatgttcctgggccagtacgtaacttagaagtgacagaaacatttgatggtgaagtgagccttgcttgggaagaacctttaactgatggtggaagcaaaatcataggttacgttgttgaaagacgtgacattaagagaaagacctgggttctggccacagaccgtgcagagagttgtgagtttactgtcactggtctacagaaaggaggagttgagtacctattccgtgtgagtgcaagaaacagagttggcactggtgagccagtagaaactgacaatcctgtagaagcaaggagtaaatatgatgttccaggccctcctttgaatgtaaccatcactgatgtgaatcgatttggtgtctcactgacatgggaaccaccagagtatgatggaggtgctgagatcacaaactacgtcattgaattaagagacaagacttctatcaggtgggatactgccatgactgtgagagctgaagacctgtctgcaactgttactgatgtggtagaaggacaggagtacagtttccgagtgagagcccaaaatcgaattggagttggaaaaccaagtgcagccacacccttcgtcaaagttgctgatccaattgagagaccaagtcctcctgtaaacctaacttcctcagatcagactcagtcatcagttcagctcaaatgggaacctcctctgaaagatggaggaagcccaatattaggctatataattgagcgatgcgaagaaggaaaagataattggattcgttgcaatatgaaacttgtccctgaactgacttacaaggttaccggattggaaaaaggaaataaatatttatatagagtatctgcagaaaataaagctggtgtttcagatccatctgaaattcttggtcctctcaccgctgacgatgcatttgttgaaccaacaatggatttaagtgcatttaaagatggtctggaagttattgtcccaaatcctatcacgatcctggttccaagtacaggctatccaaggccaactgcaacctggtgttttggagataaagtactagaaacaggggaccgggtgaaaatgaagaccttgtctgcctatgccgaacttgtcatttctccaagtgaacgttcagacaagggcatttatacactgaaattagaaaaccgtgtgaaaacaatttctggggaaattgatgtcaatgtaattgctcgcccaagtgcacccaaagaattgaaatttggtgatataaccaaggactcagtacatttgacttgggaaccacctgatgatgatggaggaagtccgttaactggatacgttgttgaaaaacgagaagtcagccggaaaacatggactaaagttatggactttgtgactgatctagaattcacagttcctgatcttgttcaaggaaaagagtacttatttaaagtttgtgctcgtaacaaatgtggccctggagaacctgcatatgttgatgaacctgtaaatatgtcaactcctgcaacggtacctgacccaccagagaatgttaaatggagagatcgaacagccaatagcatcttcttaacatgggatccacctaaaaatgatggtggttcacgcatcaaaggatatatagttgaaagatgtccacgtggttctgataaatgggttgcctgtggagaacctgttgcagaaacaaaaatggaagtgacaggtcttgaggaaggcaaatggtatgcctaccgcgtgaaggccttaaacaggcagggtgctagcaaaccaagcagacccacagaggaaatccaggctgtggacacacaagaggccccagaaatcttcctcgatgtgaagctccttgctggtctcactgtaaaagctgggaccaagattgaacttcctgccaccgtaaccggaaaacctgaacctaaaataacttggacaaaggctgatatgattctgaagcaggacaaaagaattaccattgaaaatgtccctaagaaatccacagtgactattgttgatagtaagagaagtgacactggcacatatatcattgaggctgtgaatgtgtgtggccgggccactgctgtggtggaagtgaacgtcttagataaacccggaccaccagctgcctttgacatcacagatgtaaccaatgagtcatgtcttctaacatggaacccaccacgcgatgatggtggatctaagatcacaaactatgttgtggagagacgagcaactgatagtgaagtgtggcacaagctctcatccaccgtcaaggatacaaacttcaaggccaccaaattaatccccaataaagagtacatcttcagagttgctgcagaaaacatgtatggtgttggtgaaccagttcaggcctctccaataacagccaaatatcagtttgatccacctggtcctccaactcgcctagaaccttctgatatcactaaagacgcagtgactctcacatggtgtgagccagatgatgatggtggcagcccaatcacaggatactgggttgaaagactggatcctgatacagataaatgggttagatgcaataagatgccagtaaaggacacaacatacagagtgaaaggtctcactaataagaaaaaatacagattccgtgtgttggctgaaaatcttgctggacctggaaaaccaagcaaatcaactgaaccaatcttaataaaggatcccatagatcctccatggccccctggaaaaccaactgtaaaagatgtaggcaaaacatcagtaaggttgaattggacaaaaccagaacatgatggaggtgcaaagattgagtcttatgtcattgaaatgctgaagactggaacagatgagtgggtcagagtggcggaaggggttcccaccactcagcacttgctcccagggctcatggaaggacaggaatactcattccgagttagagctgtgaataaggctggggaaagtgaacccagtgaacccagtgaccctgtgctttgccgggagaagctatatcctccatcaccaccacgctggcttgaagttattaatatcacaaaaaatacagcagacctaaaatggacagttcctgagaaagatggagggtcccccatcaccaactacattgtggaaaagagagacgtcaggcgaaaaggctggcaaacagtggataccactgtcaaggacaccaagtgcacagtcaccccactgactgagggctctttatatgtgttccgagttgctgcagaaaatgctataggacaaagcgactacaccgaaattgaggactctgtgctggccaaagacacctttaccactcctggaccaccctacgccctggcagtggttgatgtgacaaaacgacatgttgacctaaagtgggagccacctaaaaatgatggtggaagaccaatacagagatatgtcattgagaagaaagaaaggttaggtacccgttgggtgaaagctggaaagactgcaggacctgactgtaacttcagagtaactgatgtcatcgaaggaacagaggtccagtttcaggttcgggctgaaaatgaagctggagttggccacccaagtgaacccacagaaatcctatccattgaagatccaacaagtcctccctcaccaccccttgacctacatgtgactgatgctgggagaaaacacattgccattgcttggaagcctccagagaaaaatggtggaagtcctatcataggataccatgttgaaatgtgtccagtaggcactgagaaatggatgagagttaattctcgcccaataaaggacttgaaattcaaggttgaagaaggtgttgttcctgacaaagaatatgtcctgagagtgagagcagtcaatgctattggtgtcagcgagccatctgaaatctctgaaaatgtggttgccaaagacccagactgcaagccaacaattgacctggagactcatgacattattgttattgaaggtgaaaagttaagcattcctgttcccttcagagctgtcccagttccaactgttagttggcataaagatggcaaagaagttaaagcaagtgatagattaacaatgaagaatgatcacatctctgcacaccttgaagttcccaagagtgtccgtgcagatgccggaatttataccattacactggagaataagctcggctcagcaacagcctcaatcaatgtcaaagtcataggcctacctggaccatgcaaagatattaaagcaagtgacattaccaagagttcttgtaagttaacttgggaacctccagaatttgatggtggaaccccaattcttcattatgtcctggagcgcagagaagctgggaggagaacatatataccagtcatgtctggtgagaacaaactgtcatggactgtgaaggatctcataccaaatggtgaatacttcttccgtgttaaagcagtcaacaaggttggtggaggagaatatattgaactgaaaaatccagtcattgctcaagatccaaagcaaccccctgatccacctgtagatgtagaggttcataatcctacagcggaggcaatgactattacatggaagccacctttgtatgatggagggagcaagataatgggctacatcatagagaagattgctaagggtgaagaaaggtggaagagatgcaatgaacacctggtaccaatcctgacctatacagcaaaaggacttgaagaggggaaagagtaccaattccgtgtgcgagcagagaacgccgcgggtattagtgaaccttctcgggctactcctccaaccaaagctgtagatcccattgatgcccccaaagtcattctgagaacaagcctagaagtgaaacgaggtgatgaaatagcacttgatgcaagtatttctggatcaccttacccaactattacatggataaaggatgaaaatgttattgtaccagaggaaattaagaagcgtgcagcacccttggttaggagaaggaagggtgaagttcaagaagaagaaccatttgtcctgcctctgacacagcgtttgagtattgacaacagcaaaaagggagaatctcagctacgcgtccgagattctctccgacctgaccatggtctgtatatgatcaaagttgaaaatgaccacggtattgcaaaagctccttgtactgtcagtgtgttagatacaccgggaccaccaatcaactttgtatttgaagatatcagaaagacctcagtcctttgtaaatgggaaccaccccttgatgatggtggcagtgaaatcataaactacactttggaaaagaaagacaagacaaaacccgactcagaatggattgttgtcacttcaacacttagacattgcaaatattcagtaacaaaactgattgaaggaaaagagtacctcttccgtgtaagagctgaaaacagatttgggccaggtccaccatgtgtttcaaagccacttgtggctaaagatccatttggaccacctgatgcaccagataagcccattgtggaagatgttaccagcaacagtatgctagtgaaatggaatgaaccaaaagataatggaagccccattttgggttactggcttgaaaaacgtgaagttaacagtacacattggtctcgtgtcaacaaaagccttctgaatgccttgaaagccaatgtagatggcttattagaaggactcacctatgtcttcagagtatgtgctgaaaatgcagctggacctggaaagttcagtccaccttcagatcccaaaacagcacatgatccaatctctcctcctgggccacctatcccaagagtcactgacacaagctctacaactattgaactagaatgggaacccccagctttcaatggtggtggggaaattgttggctattttgttgataagcagttggttggcacaaatgaatggtcacgctgcacagagaagatgatcaaggtccgtcagtacaccgtcaaagaaatccgagagggtgctgattacaaacttcgggtgagtgctgtcaatgccgcaggggaaggaccgcctggagaaacacaacctgttactgtggctgaaccacaagagcctccagctgtggaactggatgtttctgtcaagggtggaatacaaataatggctgggaagactcttagaattccagctgtggtgactggtcgccctgtacctacaaaagtatggaccaaagaagaaggggagctggataaagaccgtgttgtaatagacaacgttggaaccaaatctgaactaattatcaaggatgcactgcgaaaagaccatggcagatatgtgattacagctacaaatagctgtggttccaaatttgcagcagccagggtagaagtttttgatgtccctggtccagttcttgacttaaaacctgttgtaacaaacagaaaaatgtgtctacttaactggtctgatccagaagatgatggaggaagtgaaataacaggctttatcattgaaagaaaagatgccaagatgcatacttggagacaaccaatagagactgagagatctaaatgtgacatcacaggtctgcttgagggacaagaatataagttccgtgttattgccaagaacaagtttggctgtggccctcctgttgaaataggaccaattcttgcagttgatccactaggtcctccaacatctccagagaggctcacatacactgaaaggacaaagtccactatcacacttgactggaaagagccccgcagtaatggtggcagtcccatccaaggatatatcattgaaaaacggcgtcatgacaaacctgactttgaaagagttaacaagcgactctgcccaaccacatcttttctggttgaaaatcttgatgaacaccaaatgtatgagttccgtgtcaaagctgtcaatgaaattggtgaaagtgaaccatccctacctcttaatgtagtcatacaagatgatgaagtgcctccaactattaagttgcgtctgagtgttcgaggagacactatcaaagttaaggcaggagagcctgtccacatccctgcagatgtgacaggccttccaatgcctaagattgaatggtccaaaaatgaaactgtaattgaaaaacccactgatgcacttcagataaccaaggaagaggtatcccgaagtgaggcaaaaactgagcttagcattcccaaagcggtccgggaggacaaaggcacttacacagttactgcttccaatcgccttggctcagtgttccgaaatgttcacgttgaagtatatgaccgcccatccccaccaagaaatcttgctgttactgacattaaagctgaatcttgctacttgacatgggatgcccctcttgataatggtggcagtgaaatcacccattatgttattgacaaacgtgatgcaagtaggaagaaagcagaatgggaggaagtcaccaacactgctgtagagaaaagatatgggatctggaaacttatccccaatggtcagtatgagttccgagtcagggcagtgaataaatatggaatcagtgatgagtgcaaatcagataaagtagtcattcaagatccttatcgccttcctggacctccaggaaaaccaaaagttttggcacgcaccaaaggatcaatgctagtgagctggactcctcctttggacaatggtggctctccaattactggctactggctggagaaaagagaagagggaagtccttattggtcacgtgttagccgagcaccaataaccaaagtgggattgaaaggcgtggaatttaatgttcctcgtttgcttgaaggcgttaaataccagttcagagccatggcaataaatgctgcaggaattggtcctcccagtgaaccatcagatccagaggttgcaggagatcccatatttccaccggggccaccttcttgcccagaagttaaagataaaacgaagtcaagcatctcactaggatggaaacctccagccaaagatggtggcagcccaatcaaaggatacattgtagaaatgcaagaagaaggtactactgactggaaaagagtaaatgaaccagacaaacttataactacctgtgaatgtgtggtgcctaatctgaaagagctcaggaagtacagattcagagtgaaagctgtcaatgaagctggtgaatctgaaccaagtgatacaactggggagatccctgccactgatattcaagaggaaccagaagttttcattgacattggagcacaggactgtctggtttgtaaagctggctcacagattaggattcctgctgtcatcaagggacgcccaacaccaaaatcatcttgggaatttgatggaaaggcaaagaaagcaatgaaggatggagttcatgacatacccgaagatgcacagctggagactgctgaaaactcctcagtaattattattccggagtgtaaacgatctcatacaggcaaatacagcatcacagccaagaataaagcaggacaaaagactgcaaattgcagagttaaagtcatggatgtaccaggcccacccaaagatctgaaagtcagtgatatcacaaggggtagttgcagactttcatggaagatgccagacgacgatggaggagacaggatcaaaggctatgttattgagaagaggactattgatggaaaagcctggaccaaagtcaatccagactgtggaagcaccacatttgtagtgcctgatctcctctctgaacagcaatatttcttccgtgtgcgagcagaaaaccgttttggtattggcccacctgtggaaaccattcagaggaccactgccagagatccgatatatcctcctgatcctcctattaaactcaagattggcctcatcacaaagaacacagtgcatctgtcatggaaacccccgaagaatgatgggggctcccctgttacccactatattgttgagtgccttgcatgggaccctactgggacaaagaaagaagcctggaggcagtgcaataagcgtgatgtggaagaactgcaatttactgttgaagacctagtagagggtggggaatatgaattccgagtcaaagctgtcaatgctgcaggagtcagcaagccttcagccactgttggccctgtgactgtcaaagaccagacatgcccaccatcaattgatctaaaagaattcatggaggttgaagaaggaaccaatgttaacattgtggccaaaattaaaggtgtgccattcccgacactaacctggtttaaagctcctccaaagaagcctgataacaaagaacctgttctctatgacacccatgtcaacaaactggtggtagatgatacttgcactttagttattccgcagtctcgcaggagtgacactggcttatataccatcacagctgtaaataatctgggaacagcatcaaaggagatgagactgaatgtcctgggtcgtcctggccctccagtgggacccataaaatttgaatctgtttcagcagatcaaatgacactatcttggtttccacctaaagatgatggtgggtctaagattacaaactatgtaattgagaaaagagaagctaacaggaagacatgggtccatgtctccagtgaacctaaggagtgcacgtacacgattcccaaattgctagaaggccatgaatatgtattccgaatcatggcccagaataaatatggcattggagaacctcttgacagtgaacctgaaacagcaagaaacctcttctctgtccctggagcaccagataaaccaacagttagcagcgtgactcgtaactccatgactgtcaactgggaagagccagaatatgatggaggctctcctgtgacagggtactggctggaaatgaaagacaccacttcaaagagatggaagagagttaaccgagatcctatcaaagccatgactttgggtgtttcttataaagtgactggtcttattgaaggttccgactatcaattccgggtatatgcaatcaatgctgctggcgtgggtccagcaagtctgccatcagacccagcgactgctagagatccaattgcccctcctggtcctccatttcccaaagtgacagattggactaaatcatctgcagatctggagtggtctcccccactaaaagatggtggatccaaagtaactggatacatcgttgaatataaagaagaaggaaaagaagaatgggaaaagggtaaagataaagaagtgagaggaacaaagcttgttgtgacaggattaaaggaaggagcattctacaaatttagagttagagcagtcaacattgctggcattggagaacctggagaggtcacagatgtcattgaaatgaaggacagacttgtttcacctgaccttcagctagatgccagtgtcagagatagaattgttgtccatgctggaggggtgatccgaatcattgcctatgtgtctggaaagcctcctccaaccgtcacctggaacatgaatgaaagaaccttacctcaagaagccaccattgagaccacagccattagctcatccatggtcatcaagaactgccagaggagccatcaaggcgtctattctcttcttgccaaaaatgaagccggagaaagaaagaagacaattattgttgatgtattagatgttccaggtcccgttggaacaccattcctagctcacaacctaaccaatgagtcctgcaaactgacatggttttctccagaagatgatggaggctctccaatcaccaattatgtcattgaaaagcgtgaatctgaccgcagagcatggaccccagtgacatatacagttacccgacaaaatgctactgtccagggtctcattcaaggaaaagcctactttttccgaattgcggctgaaaatagtattggcatgggtccatttgttgagacatcagaggcacttgttatcagagagccaataactgtaccagagcgtcctgaagacctggaagtcaaagaagttactaaaaatactgtaactttgacttggaatcctcctaagtatgatggtgggtcagaaattattaactatgtcctagaaagtcggctcattgggactgagaagttccacaaagttacaaatgacaacttgcttagcagaaaatacactgttaaaggcttaaaagaaggtgatacctatgagtaccgtgtcagtgctgtcaacattgttggacaaggcaaaccatcattttgcaccaaaccaattacttgcaaggatgagctggcacccccaacgcttcacctcgacttcagagataagctcacgattcgagttggtgaagcttttgccctcactggccgttactcaggcaaaccaaagcctaaggtttcctggttcaaagatgaagctgatgtgctggaagatgatcgcactcatataaagactacaccagcaacacttgctttagagaagatcaaggccaaacgttcagattccggcaaatactgtgtggttgtggagaacagtacaggctctaggaaaggtttctgtcaagttaatgttgttgaccgtcctggaccaccagtaggaccagttagttttgatgaggtgaccaaagattacatggttatctcttggaagcctcctttagatgatggaggcagtaaaatcaccaattatattattgagaagaaggaagtgggtaaagacgtctggatgccagtgacatctgcaagtgctaaaacaacatgcaaagtttctaaactacttgaaggaaaagattatattttccggatacatgctgaaaatctgtatggaataagtgatcctctggtgtctgattcaatgaaagccaaagatcgtttcagggttcctgatgcacctgatcagccaattgttacagaagttaccaaagactctgcattagtaacctggaataagccacatgatggaggaaaacccatcacaaactacatcctggaaaagagagaaactatgtctaaacgatgggctagagttaccaaagatcctattcatccatacactaaatttagggttcctgatcttctagaaggatgtcagtatgaattccgggtttctgcagaaaatgaaattggtattggagatccaagcccaccatccaaaccagtctttgctaaagatccaattgctaaaccaagtccacctgttaatcctgaagcaatagatacaacatgcaattcagtcgatctaacttggcagccaccacgtcatgatggtgggagcaagattctgggttatattgttgagtaccagaaagttggagatgaagagtggagaagagccaatcacacccctgagtcatgtcctgaaactaaatataaagtcaccggtcttcgggacggtcaaacctataagtttagagtgttagcagtcaatgcagctggtgaatcagatccagctcatgttccggagccagtcctagtaaaagacaggcttgaaccccctgagttgattcttgatgccaacatggcaagagaacaacacattaaagttggtgatactctaagacttagtgccatcatcaaaggagtgccattcccaaaagtaacttggaaaaaagaagacagagatgctccaactaaagcaagaattgatgtgactccagttggtagcaagcttgaaattcgtaatgctgcccatgaagatggtggaatttattctttaacagtggagaatccagctggttcaaaaactgtctcagtaaaagtacttgtattagataaacctgggccacctagagatctggaagtcagtgaaattaggaaagattcatgttaccttacttggaaagaaccactggatgatggtggttctgttattaccaattatgtggttgagaggagagatgttgccagcgcccagtggtcacctctctcagctacatcaaagaaaaagagtcacttcgctaagcatctgaatgaaggcaaccagtacctcttccgagtagctgcggagaaccagtatggacgtggtccttttgttgaaacaccaaaaccaatcaaggctttggatcctctccatcccccagggccacccaaggacctgcaccatgtagatgttgacaagactgaagtctccctagtctggaataagccggatcgtgatggtggttctccaatcactggatatttggtagaatatcaagaagaaggcacccaggactggattaaatttaagactgtgacaaacttagagtgtgtggttactggactacaacaaggaaagacctatagattccgtgtaaaagctgaaaacattgtgggtcttggtctccctgacacaactatcccgatagaatgtcaagaaaaactagtgcctccatccgtggagctagatgtgaaattaattgaaggtcttgtggtaaaggctggaaccacagtcagattccctgctattataagaggtgtgcctgttcctactgcaaagtggacaaccgatgggagtgagattaaaaccgatgagcactacacagttgaaacagacaacttctcatcagtacttaccattaagaactgcttaaggagagacactggggaatatcaaatcacagtttccaatgcagccggtagcaaaacagtagccgtacatcttactgttcttgatgttcctgggccaccaacaggtcctattaatattctggatgttactcctgaacacatgactatctcatggcagccacctaaggatgatggaggaagccctgtgataaattatattgttgagaaacaagatacaaggaaagacacgtggggtgttgtctcttccggaagcagtaagacaaagctgaaaatcccacatctgcagaagggctgtgaatatgttttccgagttagagcagagaataagataggtgttggtcctccccttgactccacacctactgttgctaagcataaatttagtcctccgtctcctcctggtaaaccagtggttactgacattactgaaaatgcagcaacagtgtcttggaccctgccaaaatctgatggtggcagtccaataactggctactatatggaacgtcgagaagtaactggcaaatgggtgagggtcaacaaaacacctatcgctgacctgaagttcagagtgactggactctatgaaggaaatacatatgagtttagagtttttgctgaaaatcttgcaggactaagcaaaccatccccaagttctgatccaataaaagcttgccggcccatcaaaccacctggaccacctattaatcctaaactgaaagacaagagcagagaaacagctgatttggtgtggacaaagcctctcagtgatggtggtagccccattctaggatatgtagtggaatgtcagaaacctggcacagcacaatggaacaggattaataaagatgaactcattaggcaatgtgcctttagggtacctggactaattgaaggaaatgagtacagattccgtataaaggcagctaatattgtaggagagggtgagccaagagaactagcagaatctgtgattgcaaaagatatccttcatcctccagaagtagaacttgatgttacttgtcgtgatgttattaccgtgagagtaggccaaactatccgcattctagctcgagtcaaaggcagacctgaaccagacataacttggactaaggaaggcaaagtattggtccgagaaaagagggtggaccttattcaggatctacctcgtgttgagttacaaattaaagaagctgttagagctgatcatggcaagtatatcatctcagctaagaacagcagtggacatgcccaaggttcagccatcgttaacgtccttgacagacctgggccttgccagaatttgaaggttaccaatgtaaccaaagagaactgtacaatttcttgggaaaacccactagataatggtggctcagaaataacaaacttcatagtagaatatcgcaaaccaaaccagaaaggctggtcaattgttgcatcagatgtcactaaacgattaatcaaggccaaccttttagccaacaatgaatactatttccgagtttgtgcagagaataaagtaggtgttgggccaaccatcgaaacaaaaactcccattctggctattaaccctattgacagaccaggtgagcctgaaaaccttcacattgcagataaaggaaagacatttgtctatctaaagtggcggaggcctgactatgatggtggcagtccaaatctgtcatatcatgttgagagaaggcttaagggctccgatgactgggaaagagtgcataaaggaagcattaaagaaactcactacatggttgacagatgtgttgaaaaccagatttatgagttcagagtgcaaacaaagaatgaaggtggggaaagtgactgggtgaagacagaggaagttgttgtgaaagaagacttacaaaaaccagtacttgatctgaaattaagtggggtcctaactgtcaaagcaggggacaccattaggcttgaggcaggggttagaggcaaaccattcccagaagttgcatggaccaaggacaaagacgctacagacttaacaagatcaccaagggtcaagattgatacccgtgctgattcatctaaattttctcttactaaagcaaagcgaagtgatgggggtaaatatgtagttacggcaactaacacggctggcagttttgtggcctatgccactgtcaatgttttagataagcctggtcctgtgagaaatctgaaaattgttgatgtgtccagtgataggtgtactgtttgctgggatccaccagaagatgatggtggctgtgaaatccaaaattatattctagaaaaatgtgagacaaagcgaatggtttggtctacctattctgctactgtcttgacacctggtactacagtaacacgtctcatagaaggaaatgaatatattttcagagtccgtgcagaaaataaaataggcacagggcctccaacagaaagtaaaccagtcatagccaaaaccaagtatgataaacctggtcgccctgatcccccagaagtcactaaagtaagcaaagaagagatgactgtggtttggaatccacctgaatatgatggtggaaagtctataactggatactttttggagaaaaaggaaaagcattcaacacgatgggtccctgtcaacaagagtgcaatccctgagagacgtatgaaagtacagaatctcctcccagaccatgaatatcagttccgtgtcaaggcagaaaatgaaattggaattggagaaccaagcttgccttcaagaccggtggtggcaaaagaccccatagagccacctggtccaccaaccaatttcagagtggttgatacaaccaaacattccataactcttgggtggggaaaaccagtctatgatggtggtgcaccgatcattggatatgttgtggaaatgagaccaaaaatagcagatgcgtctcctgatgaaggctggaaacggtgtaatgctgcagcacagcttgtacgcaaggaattcactgttaccagcttggatgaaaaccaggaatatgagttcagggtgtgtgcccaaaaccaagttggtattgggcgccctgcagagctaaaggaagctatcaaacctaaagaaatactagaacctccggagattgatttggatgccagcatgaggaaactggtcatagtgagagcaggatgccctattcgtctctttgctatagtgagaggacgaccagcccctaaagtcacttggcgaaaagttggcattgataatgtggtcagaaaaggacaagttgatctggttgacactatggccttccttgtcatccccaattctacccgtgatgactcaggaaaatattccttaacacttgtgaacccagcaggagaaaaggctgtattcgtaaatgtcagagtattagacactcctgggcctgtgtctgatttaaaagtttcagatgtcactaaaacatcatgccatgtgtcctgggcccctcctgaaaacgacggtgggagccaagtgacacattatatcgtggagaaacgtgaggcagacagaaagacatggtcgaccgttaccccagaagttaagaaaacaagcttccatgtaaccaatcttgtccctgggaatgagtattacttcagagtaactgctgtcaacgaatatggccctggcgtcccaacagatgtcccaaaaccagtgcttgcatcagatcctctaagtgagccggatcccccaaggaaattagaagtgactgaaatgaccaagaacagtgccaccttagcctggttacctcccctacgtgatggaggtgctaaaatcgatggctacatcactagttacagagaagaagagcagcctgcagatcgctggacagagtactcagtggtaaaagatctgagccttgttgtcactggcctaaaggaaggaaagaaatacaaatttagagtagcggccagaaatgctgttggagtcagtttgccaagagaagctgaaggagtgtatgaagccaaagaacaactgttgccaccaaagatccttatgccagagcaaataactatcaaagctgggaaaaaactccgaattgaagcccatgtgtatggaaagcctcatcccacctgtaaatggaaaaaaggagaagatgaagttgtcacatccagccacctggcagtgcataaagcagacagctcttcaattctgatcataaaagatgtgactaggaaagacagtggttactacagcctcacagcagagaacagttctgggacagacactcagaaaatcaaagttgtagtcatggatgcccccggcccccctcagcctccatttgacatttctgatatagacgctgatgcttgctccctgtcatggcacatccctctggaggacggaggcagtaacatcaccaattatatagtggagaagtgtgatgtaagccgaggtgactgggtcacggctctagcttcagtcacaaaaacttcctgcagggttggaaagctgatcccaggccaggagtacatcttccgggtccgtgctgaaaaccgatttggcatttcagagcctctcacatctccaaagatggttgcgcagttcccatttggtgttcctagtgaaccaaagaatgcacgagtcaccaaagtcaacaaggactgtatttttgttgcttgggacagaccagatagtgatggagggagccccattattggttatctgattgaacgcaaggaaagaaacagtttgctgtgggtgaaagccaatgatactcttgtccggtcaactgaatatccttgtgctggccttgtagaaggtcttgagtattcattcagaatctatgccctaaacaaagctggatccagcccacccagcaaacccacagaatatgtaactgcaagaatgccagttgatcctcctgggaaacctgaggttattgatgtcaccaagagtactgtatctctgatctgggctcgtccaaagcatgatggaggcagtaaaattattggctatttcgtagaagcttgcaaacttcctggtgataaatgggtacggtgcaatactgcacctcaccagattccccaggaagagtacacagctactggcctagaagagaaagctcagtatcaatttagagctattgccaggaccgcggtaaacattagcccaccttctgaaccttctgatccagtgactatcctcgcagaaaatgtccctcccaggatagacctgagtgtggctatgaaatctttgcttactgtgaaagctggaactaatgtctgcttggatgctactgtttttggtaaaccgatgccaacagtttcttggaaaaaagatggcacactgctaaaaccagcagaaggcataaagatggccatgcagcggaatctgtgcaccttggagctattcagcgtgaaccggaaggactcaggagactataccattactgctgaaaattcaagtggttctaaatcagccaccattaagcttaaagtgttagataaaccgggtcctccagcatctgttaaaatcaacaaaatgtattcagatcgtgctatgctttcttgggaaccgcctcttgaagatggaggctcagaaatcaccaactatattgttgacaaacgtgaaacaagcaggcccaactgggctcaagtctctgcaactgtgcctatcaccagctgcagcgtggagaaacttatagagggccatgagtatcagttccgtatttgtgctgaaaataaatatggagtaggcgatccagtcttcactgaaccagcaattgccaaaaacccatatgacccaccaggacgctgtgatcctcctgttattagcaacataaccaaagatcacatgacagtcagctggaagccaccagcagatgatgggggctcacccatcactggctatttgcttgaaaagcgggaaacccaggctgttaactggactaaggtcaacagaaaacctattatagaaagaacattaaaagcaacaggtcttcaagaaggtaccgaatatgagttccgtgttacagctataaataaagctggaccaggcaaacccagtgacgcatccaaggccgcttatgctcgggaccctcagtatcctcctggcccaccggctttccctaaagtatatgatacaactcgcagctctgtgagtctatcttggggcaagccagcctatgacggcggcagccctatcattggttatctcgttgaagtaaaacgggctgactccgataactgggtgaggtgcaacttaccacagaatctacagaaaacccgctttgaggttactggcctgatggaagacacacaatatcaattccgtgtgtatgccgttaataagattggatacagtgaccccagtgatgtgccagataaacactatcccaaggacatcttaattccacctgagggagaacttgatgcggacttaaggaagacactcatattacgtgctggagttactatgagactatatgtaccagtaaaaggacgcccacctccaaagattacttggtctaaaccaaatgtcaatctaagagacaggattggactggacataaagtcaactgactttgacactttcttgcgctgtgaaaatgtgaacaaatatgatgcaggaaaatatatcttaaccctggagaacagctgtggtaaaaaggaatataccattgttgtgaaagtgcttgatactcctgggccacctgtcaatgtgactgttaaggaaatatccaaagactctgcttatgttacctgggagcctcccattattgatggcggaagccccatcataaactatgtggtacaaaaacgtgatgcagagaggaaatcctggtctacagtgacaactgagtgctccaaaacaagcttcagagtagctaatttggaggagggaaaatcctacttcttccgagtgtttgctgaaaatgagtatggcattggtgatcccggtgaaactcgtgatgctgtcaaagcttcccaaactcctggaccagttgtggacctgaaagtgaggtctgtatctaagtcatcctgtagcattggctggaaaaagcctcacagtgatggtggaagtcggattattggatatgtagttgatttcctgactgaagaaaataagtggcaacgagttatgaaatccttaagcctacagtactctgcaaaagatttgactgaagggaaggaatataccttcagagtgagtgctgagaatgaaaatggagaaggaaccccaagcgaaatcactgttgtggcaagggatgatgttgtggctcctgatcttgacttaaagggtctacctgatttgtgctacttggctaaagaaaacagcaacttccggcttaagatccccataaaaggcaagccagctccatcagtctcctggaagaaaggggaagatcctctagcaactgacactagagtcagtgttgagtcatctgcggttaacacaactcttatagtgtacgattgccaaaaatctgatgctggaaaatacacaatcacacttaagaatgttgctggcaccaaggaaggaactatctccataaaggttgttggcaagcctggcatccccactggaccaatcaaatttgatgaagtcacagcagaagccatgaccttaaagtgggctcctccaaaggatgatggaggttctgaaatcaccaactatatcctagagaagagggattctgtgaacaacaagtgggtgacgtgcgcctcagctgtccagaaaaccacctttagagtaaccagacttcatgagggcatggaatataccttcagggtcagtgccgaaaataaatatggtgtaggggaaggcctgaaatcggagccaattgttgcgagacatccatttgatgtgcctgatgctcccccacctcccaatattgtggatgtcagacacgattcagtatctctaacttggactgaccccaagaaaactggtggttctccaattacagggtatcatctcgagttcaaggaaagaaacagccttttgtggaagagagctaacaagactccgataaggatgagagactttaaagtgacaggattaactgaaggtcttgaatatgaattccgagttatggcaatcaatttagcaggtgtgggcaagccaagcctaccatcagagcctgttgtggcactggacccaattgatcctcctggaaaacctgaggttattaacataacaaggaattcagtgactctcatttggactgaacctaaatatgacggtggtcataagttaactggatatatagtggagaagcgagatctaccttcgaagtcttggatgaaagccaaccatgttaatgtcccagaatgtgcctttactgtaactgaccttgttgagggtggaaaatatgaattcagaattagagcaaagaatacagcaggtgctatcagtgctccatcagaaagtacagaaaccattatttgcaaggatgaatacgaggcaccaacaattgtccttgatcccacaataaaagatgggctaacaattaaagcaggggataccattgttttgaatgccattagcattcttggcaaaccccttccaaaatcaagttggtccaaggcaggaaaagacattagaccatcagatatcactcagataacttcaaccccaacatcttccatgcttactatcaagtatgccactagaaaagatgcgggtgaatataccatcactgctaccaatccttttggcacgaaggtggaacatgtgaaggtaacagtccttgatgtacctggtcccccaggtcctgttgaaatcagtaatgtttctgctgaaaaagcaacacttacatggacacctcccttggaagatggcggctcaccaattaagtcctatatacttgaaaagagagaaaccagccgacttttgtggacagtggtttctgaagatattcagtcttgcaggcatgtggcaaccaaacttatccaaggaaatgagtacatcttccgggtctcagctgtaaaccactatggcaaaggagaacctgtacagtctgaacctgtcaaaatggtagacagatttggtccccctggccctcctgaaaaaccagaggtatcaaatgtcactaagaacactgccactgtcagctggaaaaggccagtggatgatggtggcagcgaaattacaggatatcatgtagaaaggagagaaaagaaaagcctgcgatgggtgagagcaataaaaacaccagtttccgatctcaggtgcaaagtaacaggactgcaagaaggaagcacctacgaattccgtgtcagtgcagaaaacagagcaggaattggtccacccagtgaggcttcagattctgttctgatgaaagatgcagcatatcctccaggaccaccttcaaatccgcatgtcactgatactaccaagaaatctgcttctttggcatggggcaagcctcattatgatggtggacttgaaatcactggctatgtcgtggagcatcaaaaagtaggagacgaggcctggataaaagataccacaggaaccgccctcagaatcactcagttcgttgttcctgatcttcagactaaagaaaaatacaacttcagaatcagtgccatcaacgatgcaggtgttggggagccagcggtgattccagatgttgaaatcgtagaacgggagatggctcctgattttgaactagatgccgagcttcgaagaacacttgttgttagagcaggactcagtattaggatatttgtgccaattaaaggtcgtcctgctcctgaagtgacatggaccaaagataacatcaacctgaaaaaccgagccaacattgaaaatacggaatcatttactcttctgattatcccagaatgtaacagatatgataccggtaaatttgtcatgaccattgaaaacccggctgggaagaaaagtggctttgtgaacgtcagagtcttggacacgccaggcccagtcctcaacctgcggcctacagacatcacaaaggacagtgtcaccctgcactgggacctccctctgatagatggaggctcacgtataacaaactacattgtagagaaacgtgaagcaacacggaaatcttattccacagccaccactaagtgccataaatgcacatataaagttaccggcttgtctgaagggtgtgaatatttcttcagagtgatggcagagaatgaatatggaattggtgagccaacagaaactacagagcccgtaaaagcctctgaagcaccatctccaccagacagccttaacatcatggacataactaagagcaccgtcagcctggcatggcctaagcccaaacacgatggtggcagcaagatcactggctatgtgattgaagcccaaagaaaaggctctgaccagtggacccacatcacaaccgtgaaagggttagaatgtgttgtgaggaatctaactgaaggagaggaatataccttccaagtgatggcagtgaacagcgcggggagaagtgcccctagagaaagcagacccgtcattgtcaaggagcagacaatgcttccagagctggatctccgtggcatctatcagaaactggtcattgccaaagctggtgacaacatcaaagttgaaattccagtgctcggtcgaccgaagcccacagtgacatggaaaaaaggagaccaaattcttaaacagacacagagagttaattttgaaaccacagcgacttcaaccattttaaatatcaatgagtgtgtcagaagtgatagtgggccctatccattaacagcaaggaacattgtaggagaggttggtgatgtcatcaccattcaagtccatgatatcccagggccacctactggaccaatcaaatttgatgaagtttcatctgattttgtaaccttctcttgggacccacctgagaacgatggtggtgtaccaataagcaactatgtagtggaaatgcggcagactgacagtactacctgggttgagttagcaaccaccgttatacgtactacctataaagccacccgccttactactggattagagtatcagttccgtgtaaaagctcagaatagatatggagttggaccaggcatcacatcagcatgcatagttgccaactatccatttaaggttcctggacctcctggtacccctcaggtaactgcagttaccaaggattcaatgacaattagctggcatgagccactttctgatggtggaagccccattttaggatatcatgttgaaagaaaagaacgaaatggtattctctggcagactgtgagcaaagctttagtaccaggcaacattttcaaatcaagtggacttacagatggtattgcttatgagttccgggtgattgcagaaaacatggcaggcaaaagtaagccaagcaagccatcagaacctatgttggctctggatcccattgacccacctggaaaaccagtacctctaaatattacaagacacacagtaacacttaaatgggctaagcctgaatatactgggggctttaaaattaccagttatatcgttgaaaagagagaccttcctaatggacggtggctgaaggccaacttcagcaacattttggagaatgaatttacagtcagtggcctaacagaagatgctgcatatgaattccgtgtgatcgccaaaaatgctgcaggtgccatcagtccaccatctgagccatctgatgctatcacttgcagggatgatgttgaggcaccaaagataaaggtggatgttaaatttaaggacacggttatattaaaagcaggtgaagcattcagactggaagctgatgtttcaggccgcccacctccaacaatggaatggagcaaagatggaaaagagctggaaggcacagcaaagttagaaataaaaattgcagatttctctactaatctggtaaacaaagattcaacaagaagggatagtggtgcctatacccttacagcgactaatcctggtggctttgctaaacacattttcaatgtcaaagttcttgacagaccaggcccacctgaaggacctttggctgtaactgaagtgacatcagaaaagtgtgtactatcatggttccctccactggatgatggaggtgccaaaattgatcattacatagtacagaaacgtgaaaccagcagattggcatggacaaatgtagcctcagaagtccaagtaacaaagctaaaggtcactaaactcttgaaaggcaatgaatacatattccgtgtcatggctgtaaataaatatggagtgggagagccactggaatcagagcctgtgcttgcagtgaatccttatggaccccctgatccgcccaaaaaccctgaagtgacaactattactaaagattcgatggttgtctgctggggacatcctgattctgatggtggaagtgaaatcatcaattatattgtggaacggcgtgataaagctggccaacgctggattaaatgcaacaaaaaaactcttactgatttaagatataaagtgtctggactgacagaaggacatgaatatgagttcaggattatggctgaaaatgctgctggaattagtgcaccaagtcctaccagtccattttacaaggcttgtgacactgtgtttaaacctggaccaccaggtaacccacgtgttctggatacaagcagatcatccatttcaatcgcttggaataaacctatctatgatggtggttcagaaatcactgggtatatggttgagattgccctgccagaggaagatgaatggcagattgtcactccaccagcaggactcaaggcaacttcgtatactatcactggcctcacagagaatcaggaatataagatccgcatctatgccatgaattccgaaggacttggggaacctgcccttgttcctggaactccaaaggctgaagacagaatgctgcctccagaaattgaactggatgctgacctgcgcaaagttgttactataagggcctgctgcaccctgagactttttgttcccatcaaaggaaggcctgcacctgaggtgaagtgggcccgggaccatggagaatctttagataaagctagcatcgaatccacaagctcttacaccctgcttattgttggaaatgtaaacagatttgacagtggcaaatatatactaactgtagaaaatagttcaggcagcaagtctgcatttgtcaatgttagagttctcgatacaccaggccccccacaggatctgaaggtaaaagaggtcactaagacatctgtcacactcacatgggacccacctctccttgatggaggttcaaaaatcaagaactatattgttgaaaagcgggaatcaacaagaaaagcatattcaactgttgcaacaaactgccacaagacttcctggaaggtagaccagcttcaagaaggctgtagctactatttcagggttctcgcagaaaatgaatatggcattgggctgcctgctgaaaccgcagaatctgtgaaagcatcagaacgacctcttcctccaggaaaaataactttgatggatgtcacaagaaatagtgtgtcactctcttgggagaaaccagagcatgatggaggcagccgaattctaggctacattgtggagatgcagaccaaaggcagtgacaaatgggccacgtgtgccacagtcaaggtcactgaagccactatcactggattaattcagggtgaagaatactctttccgtgtttcagctcagaatgaaaagggcatcagtgatcctagacaactgagtgtgccagtgatcgccaaagatcttgtcattccaccagccttcaaactcctgttcaatactttcactgtactggcaggtgaagacctaaaagttgatgttccattcattggccgccctaccccagctgtaacctggcataaagataatgtaccactgaagcagacaactagagtaaatgcagagagcacagaaaataattcactactgacaataaaggacgcctgccgagaagatgttggccattatgtggttaaactgactaactcagctggtgaagctattgaaacccttaatgttatcgttcttgacaaaccagggcctccaactggaccagttaaaatggatgaagtgacagctgatagtattactctttcctggggcccacccaagtatgatggtggaagttctatcaataattacattgttgagaaacgggacacttccacaaccacctggcaaattgtatcagctacagttgcaaggacaacaataaaggcttgcagactgaagactggatgtgaatatcagtttagaattgcagctgaaaacagatatgggaagagtacctacctcaattcagagcctactgtagcccaatatccattcaaagttcctggtcctcctggcactccagttgtcacactgtcctccagggacagcatggaagtacaatggaatgagccaatcagtgatggaggaagtagagtcattggctatcatctagaacgcaaggaaagaaatagcatcctctgggttaagttgaataaaacacctattcctcaaaccaagtttaagacaactggccttgaagaaggtgttgaatatgaatttagagtctctgcagagaacatcgtgggcattggcaagccgagtaaagtatcagaatgttatgtggctcgtgacccatgtgatccaccaggacggccagaggcaatcattgtcacaaggaattctgtgactcttcagtggaagaaacccacctatgacggtggaagcaagatcactggttatattgttgagaagaaagaattacctgagggccgttggatgaaagccagttttacaaatattattgacactcattttgaagtaactggcctagttgaagatcacagatatgagttccgggttatagcccgaaatgccgcaggagtgtttagtgagccttcagaaagcacaggagcaataacagctagagatgaggtagatccaccacgaataagtatggatccaaaatacaaagacacaatcgtggttcatgctggtgaatcattcaaggttgatgcagatatttatggcaaaccaataccaaccattcagtggataaaaggtgatcaggagctttcaaacacagctcgattagaaataaagagcaccgactttgccaccagtctcagtgtaaaagatgcagtacgtgtcgacagtggaaattacatactgaaggccaaaaatgttgcaggagaaagatcagttactgtgaatgtcaaggttcttgacagaccagggccacctgaaggacctgttgttatctcaggagttacagcagaaaaatgcacactagcttggaaacccccacttcaggatggtgggagtgacatcataaattatattgtggaaaggagagaaaccagccgcttagtttggactgtggttgatgccaatgtgcagactctcagctgcaaggttactaagcttcttgaaggcaatgaatatactttccgtataatggcagtaaacaaatatggtgttggtgaacctcttgaatctgagccagtagttgccaagaatccatttgtagtaccagatgcaccaaaagctccagaagtcacaacagtgaccaaggactcaatgattgttgtatgggaaagaccagcatctgatggtggtagtgaaattcttggatatgttcttgagaaacgggataaagaaggcattagatggacaagatgccataagcgtctgattggagagttgcgcctgagagtaactggactcatagaaaatcacgattatgagttcagagtttctgctgagaatgctgctggacttagtgaaccaagccctccttctgcttaccaaaaggcttgtgatcctatttataaaccaggacccccaaacaaccccaaagtcatagacataaccagatcttcagtattcctttcttggagcaaaccaatatatgatggtggctgtgaaattcaaggatacattgttgaaaaatgtgatgtgagtgttggtgaatggacaatgtgcactccaccaacaggaattaataaaacaaacatagaagtagagaagctgttggaaaagcatgaatacaacttccgtatctgtgctattaataaagctggagttggagaacatgctgacgtccctggacctattatagttgaagaaaaattagaagcaccagacattgatcttgacctagaactaaggaaaatcataaatataagggcaggtggctccttaaggttatttgttcctataaaaggtcgtcctacaccagaagttaaatggggaaaggtggatggtgaaatccgagatgcagctataattgatgtcactagcagtttcacctctcttgttcttgacaatgtcaaccgatatgatagtggaaaatatacgcttacattagaaaacagcagtggaacaaagtctgcctttgttactgtgagagttctggacacgccaagtccacctgttaacctgaaagtcacagaaatcaccaaagactcagtatcaattacatgggaacctcctttgttggatgggggatccaaaataaaaaattacattgttgagaaacgtgaagccacaagaaaatcatatgctgctgttgtaactaactgccataagaattcttggaaaatcgatcagctccaagaaggttgcagttattactttagagtcacagctgagaatgagtatggtattggccttcctgcccagactgctgatccaattaaggttgcagaagtgccacaacctcctggaaaaataactgtggatgatgtcaccagaaacagtgtctctctgagttggacaaaacctgaacatgatggtggcagtaaaatcattcagtatattgtggaaatgcaagctaaacacagtgagaaatggtcagagtgtgctcgagtaaagtctcttcaggcagtaattaccaacctaactcaaggggaagaatatctttttagagttgttgctgtaaatgaaaaggggagaagtgatcctcggtcccttgcagttccaatagttgccaaagatctggtaattgagccagatgtaaaacctgcattcagtagttacagtgtacaggttggccaagatttgaaaatagaagtgccaatttctggacgtcctaagccaaccattacctggactaaagatggtctcccactgaagcagaccacaagaatcaatgttaccgattcactggatctcaccacactcagtattaaagaaactcataaggatgatggtggacaatatggaatcacagttgccaatgttgttggtcagaagacagcatccatcgaaattgtaactctagataaacctgatcctccaaaaggacctgttaaatttgatgacgtcagtgctgaaagtattacattatcttggaaccctccattatatacagggggctgccaaatcaccaactacattgttcagaaaagagatacaaccaccacagtatgggatgttgtttctgctactgttgctagaactacactcaaagtgaccaaactgaaaactggtacagaataccaatttagaatatttgccgaaaacagatatggacaaagctttgccttagagtctgatccaattgtagctcaatatccctacaaagaaccaggccctccaggtacaccatttgccacagccatttccaaagactccatggtcatacagtggcatgaaccagtcaacaatggtggaagccccgtcataggttaccacctggagagaaaagaaagaaacagtattttgtggacaaaggtcaacaaaactattattcatgacacccaattcaaagcacagaatcttgaagaaggcattgaatatgaattcagagtgtatgctgaaaatattgttggtgtaggcaaagcaagcaagaattctgaatgctatgtagccagagatccctgtgacccaccaggaaccccagaaccaataatggttaaaagaaatgaaatcactttacagtggaccaaacctgtgtatgatggtggaagtatgattacaggctacattgtagagaaacgtgatttgcctgatggtcgttggatgaaagctagctttacaaatgtcattgaaactcaatttactgtgtcaggtcttactgaagatcaaagatatgaattcagagtcattgcaaagaatgcagctggtgcaataagtaaaccctctgacagtactggaccaataactgccaaggatgaggttgaactcccaagaatttcaatggatccaaaattcagagacacaattgtggtaaatgctggagaaacattcagacttgaggctgatgtccatggaaagcccctacctaccattgagtggttaagaggagataaggaaattgaagaatctgctagatgtgaaataaagaacacagatttcaaggctttacttattgtaaaagatgcaattagaattgatggtgggcagtatattttaagagcttccaatgttgcaggttctaagtcattcccagtaaatgtaaaagtattagatagaccaggacctccagaagggccagtccaggttactggagtcacttctgaaaaatgctctttaacatggtctccaccacttcaagatggtggcagtgacatttctcactatgttgttgaaaagcgagaaaccagtcgacttgcctggactgttgttgcttcagaagttgtgaccaattctctgaaagttaccaaactcttagaaggtaatgaatatgttttccgtataatggctgtcaacaaatatggtgttggagagcctttggaatctgcaccagtactaatgaaaaatccatttgtgcttcctggaccaccaaaaagcttggaagtcacaaatattgccaaagactccatgaccgtctgttggaaccgtccagatagtgatggtggaagtgagattattggttacattgtagagaaaagagacagaagtggcattcgatggataaaatgtaataaacgccgcattacagatttgcgtctaagagtgacaggattaacagaagatcatgagtatgaattcagggtctctgcagaaaatgctgctggagttggggaaccaagtccagctacagtttattataaagcctgtgatcctgtgttcaaacctggcccacctaccaatgcacacattgtagacaccactaaaaattcaatcacacttgcctggggtaaacccatctatgatggcggcagtgagatcttgggatatgtagtagaaatctgtaaagcagatgaagaagaatggcaaatagttactccacagactggcctgagagtcactcgatttgaaatttcaaaactcactgaacaccaagagtataaaatacgagtctgtgccctcaacaaagttggtttaggtgaggctacatcagttcctggtactgtgaaaccagaagataaacttgaagcacctgaacttgaccttgactccgaattaagaaaaggaattgttgtaagagctggtggatctgccagaattcacattccattcaaaggtcgtccaacgcctgagatcacttggtctcgagaggaaggtgaattcacagataaggtccaaattgaaaagggagtaaactatacccaactatcaatagataactgtgatagaaatgatgctggaaaatacattcttaagttggaaaacagcagtggatcaaagtctgcttttgtaactgtgaaagttcttgacactccaggaccaccacagaatttggcagtcaaagaagtgagaaaagattctgccttcctggtatgggagccacccatcattgatggaggggcaaaggtcaagaactatgtgattgacaaacgtgagtcaaccagaaaagcgtatgctaatgtgagtagtaaatgcagcaaaacaagttttaaagtggaaaaccttacagaaggagccatttattacttcagagtcatggctgaaaatgaatttggagttggtgttccagtggaaactgttgatgccgtgaaagctgctgaacctccttccccaccaggaaaggttacactcactgatgtgtcccagaccagtgcatcacttatgtgggagaaacctgaacatgatggcggtagcagagtcctggggtacgttgttgaaatgcagcccaaaggaactgaaaaatggagcattgtggctgaatccaaagtctgtaatgcagttgttactggtttgagttctggacaagaatatcagttccgtgtcaaggcttataatgagaaaggaaaaagcgatccaagagtgttgggtgttcctgtcatagccaaggacttgactatacagcctagtttaaagttaccatttaacacatatagtatccaagctggagaagatcttaaaatagaaattccagttataggccgaccaagacctaacatttcttgggtcaaagatggtgagcctcttaaacagacaacaagagtaaacgttgaagaaacagctacctcaactgttttgcacattaaagaaggtaacaaagatgactttggaaaatacaccgtaacggcaacaaatagtgcaggcacagcaacagaaaatctcagtgttatcgttttagaaaagcctggacctccagttggcccagttcggtttgatgaagttagtgcagactttgtagtcatatcttgggaacctccagcctatactggtggctgccaaataagcaactacattgtagagaagcgagatacaaccaccaccacttggcacatggtatcagcaacagttgcaagaacaacaattaaaataaccaaactgaaaacaggcacggagtaccagtttagaatttttgctgaaaacaggtatggaaaaagtgccccactggattctaaggcagttattgtacaatatccatttaaagaacctggaccacctggaactccttttgtgacatcaatctcaaaagatcagatgcttgtgcaatggcatgagccagtgaatgatggaggcaccaaaattattggctaccatcttgaacagaaagaaaagaacagtattttatgggtcaagttaaataagacccccattcaggacaccaaattcaaaacaactgggcttgatgagggccttgagtatgagttcaaagtttctgctgaaaatattgttggcattggcaagcctagcaaagtgtcagaatgctttgttgctcgtgatccatgtgacccacctggtcgccctgaagccattgttattacaagaaacaatgtcacactgaaatggaagaaacctgcctatgatggtggtagcaaaataacaggttatattgtagaaaagaaagatctacctgatggccgctggatgaaagccagctttaccaacgtattagaaactgaatttacagtgagtggacttgtagaagaccaaagatatgaatttagagtaattgcaagaaatgcagctggaaactttagtgaaccatctgatagtagtggtgccattactgcaagagatgaaattgatgcaccaaatgcctctctggatccaaaatataaagatgtcatcgttgttcatgcaggagagacttttgttcttgaagccgacatccgtggcaaacctatacctgatgttgtttggtcaaaagatggaaaagaacttgaagaaacagctgctagaatggaaattaaatctactattcagaaaacaactcttgttgtcaaagactgtatacggactgatggaggacaatatattctgaaactcagcaatgttggtggtacaaagtctatacccatcactgtaaaggtacttgacaggccagggcctcctgaagggcctctgaaagttactggagttactgcggaaaaatgttacctggcatggaacccacctttgcaagatggtggtgctaatatttcacattacatcattgaaaagagggagacaagccgactctcttggacccaggtttcaactgaggtacaggcccttaactacaaagttactaaacttcttcctggtaatgagtacattttccgtgtcatggctgtgaataaatatggaattggagagcccttggaatctgggcctgttacggcctgtaatccttataagccaccaggtcctccctcaacacctgaagtctcagcaatcaccaaagattctatggtagtaacatgggcacgcccagtagacgacggaggtaccgaaattgagggctacattcttgaaaaacgagataaggaaggcgttagatggaccaagtgcaacaagaaaacattaacggatctgcggctcagggtaactggtcttaccgaaggccattcctatgaattcagagttgctgctgaaaatgcagctggtgtgggagaacctagtgagccatctgttttctaccgtgcgtgtgatgccttgtatccaccaggtcccccaagcaatccaaaagtgacggacacttccagatcttctgtctccctggcatggagtaagccaatttatgatggtggcgcacctgttaaaggctatgttgtagaggtcaaagaagctgctgcggatgaatggacaacctgcactccaccaacaggattacaaggaaagcagttcacagtgaccaagcttaaagaaaacactgaatataacttccgtatttgtgccatcaattctgaaggtgtaggtgaacctgcaactctacctggctcagtggttgctcaggagaggatagagccaccagaaatagaactcgatgctgatctcagaaaggtggtcgttctgcgtgcaagtgctactttacgcttatttgtcactatcaaaggtcgaccagaacccgaagttaaatgggaaaaggcagaaggcattctcactgacagggctcagatagaggtgaccagctcatttacaatgttggtgattgataatgttaccagatttgacagtggtcggtataatctgacattagaaaataatagtggctccaaaacagcttttgttaacgtcagagttcttgactcaccaagtgcccctgtgaatttgaccataagagaagtgaagaaagactcagtgacgttgtcctgggaaccaccacttattgatggtggagctaagattacaaactacattgtcgaaaaacgagaaactacaagaaaagcctatgctaccattacaaataattgcactaaaactactttcagaattgaaaatctacaagaaggatgttcttactacttccgagtcttggcttccaatgaatatgggattggtttgccagctgaaacaacagaacccgttaaagtgtctgaaccacccctcccacctggaagagtaactcttgttgatgtgacccgtaatacagctacaattaagtgggagaaaccagaaagtgatggtggcagcaaaattactggttatgtggttgaaatgcagactaaagggagtgaaaagtggagcacctgcacacaagttaagactctagaagcaactatatctggcttaactgcaggagaagagtatgtcttcagggtagctgcagttaacgaaaagggaagaagtgatccaagacaacttggagtgccagtaattgcaagggatattgaaataaagccttcagttgagcttcctttccatactttcaatgtaaaggctagagaacaacttaagattgatgtgccattcaaaggaagacctcaagctactgtgaactggagaaaagatggtcagactcttaaagagacaactagagtcaatgtttcttcttcaaagactgtaacatcactatctattaaggaagcttcaaaggaagatgttggaacttatgaattatgtgtttcaaacagtgctggatccataacagttcctattactataattgtccttgacagaccaggacctccaggtcctatacgtattgatgaggttagttgtgacagcataaccatttcttggaatcctccagaatatgatggtggctgccaaattagcaattacattgttgaaaagaaagaaaccacctctacaacatggcacatagtttcacaagcagttgcaagaacatccattaaaatagttcgcctgacaacaggaagtgagtatcagttccgtgtttgtgcagaaaaccgctatggaaagagctcctacagtgaatcttcagctgttgttgcagagtatccattcagtcccccaggtcctcctggtactcctaaagttgtgcatgccacaaaatctaccatgcttgtaacctggcaagtgccagttaatgatggaggaagtcgagtaattggctatcatcttgagtataaagaaagaagcagcattctttggtcaaaagcaaataaaatcctcattgctgatactcaaatgaaagtctccggccttgatgaaggactgatgtatgagtatcgtgtatatgctgaaaatattgctggaattggtaaatgcagtaaatcttgtgaaccagtccctgcaagagatccttgtgaccctcctggacaacctgaagtcacaaatatcacaagaaaatcagtgtcacttaaatggtctaaaccacattatgatggtggagctaagatcacaggatacattgttgaacgcagagaactaccagatggccggtggctgaagtgcaattatactaatatacaagaaacatactttgaagtaactgaacttactgaagatcagcgttatgaattccgggtttttgcaaggaatgctgctgactcagttagtgagccatctgaatccactgggcctattatagttaaagatgatgttgagcctccaagagttatgatggatgtcaagttccgagacgttattgttgtcaaagctggagaggtccttaagataaatgcagacattgcagggcgacctctgccagtaatttcctgggccaaggatggtatagaaattgaagaaagagcaagaacagaaatcatctcaacagacaatcatactttgttaacagttaaagactgtataagacgagacactgggcaatatgtactaacactgaagaatgttgccggcactcggtctgtggccgttaattgcaaagtacttgataagcctggtccaccagcaggaccacttgaaataaatggcctcactgctgagaaatgctctctttcctggggacgtccccaagaagatggtggtgcagatatcgactattacatcgtagaaaaacgtgaaacaagccaccttgcatggacaatatgtgaaggagagttacagatgacatcctgtaaagtaaccaagttactcaaaggcaatgaatatatatttagagtaactggtgttaataaatatggtgttggtgagcccctagagagtgtagctataaaggcactagatccatttacagttccaagtccacccacgtctttggaaattacttctgtgaccaaagaatctatgacactttgctggtcaagacccgagagtgatggaggtagtgaaatatctggatatataattgaaaggcgagagaaaaatagcctaagatgggtgcgtgtaaacaaaaaaccagtttatgatctaagagtgaaatcaacaggacttcgggaaggatgtgaatatgaatatcgtgtttatgcagaaaatgctgctggcctaagtcttccaagtgaaacctctcccttaattagggcagaagatccagtgttcctaccatctcctccatccaaacccaaaattgtggactcaggcaagacaactataactattgcctgggttaagccgctgtttgatggtggggccccgataactggatatactgtagaatacaaaaaatctgatgacactgactggaaaacttccattcagagcttacgagggacagaatatacaataagcggactaacaacaggagctgaatatgttttcagagtaaaatctgtcaataaggttggtgctagtgaccccagtgatagctctgaccctcagatagcaaaggaaagagaagaagaacctttatttgatattgacagtgaaatgaggaagaccttgattgtcaaggctggtgcctcatttaccatgactgtgcctttccgaggaagaccagtacccaatgtcttgtggagtaagccagacactgacctccgtactagagcttatgttgataccacagactctcgtacatcactgaccattgaaaatgccaacagaaatgactctggaaagtacacattaacaattcagaatgttttgagtgctgcttcactgaccttagttgtcaaagttttagataccccaggtcctccaaccaacattactgtgcaagatgtaaccaaagagtctgcagtgttatcctgggatgttcctgaaaacgatggtggagcaccagtgaagaattaccacatagaaaaacgtgaggccagcaagaaagcatgggtctctgtgaccaacaactgtaaccgcctctcctacaaagttaccaatttacaagaaggagctatctattacttcagagtctctggagaaaatgagtttggtgttggtataccagctgaaacaaaggaaggagtaaaaataacagaaaaaccaagcccacctgaaaaacttggagtaacaagtatatccaaagacagtgtttccctgacctggctgaagcctgaacatgatggcggaagcagaattgtacactatgtcgttgaagcactagaaaaaggacagaaaaactgggttaaatgtgcagtggcaaagtcaacccatcacgttgtttccggtctgagagagaattctgaatactttttccgagtgtttgctgaaaatcaagctggcctgagtgacccgagagagcttctgcttcctgttcttattaaggagcaactagaaccacctgaaattgatatgaagaatttcccaagtcacactgtatatgttagagctggttcaaaccttaaagttgacattccaatctctggaaaaccacttcccaaagtgaccttatcaagagatggtgtcccccttaaggcaaccatgagatttaataccgaaattactgctgagaacctgaccatcaatctcaaagaaagtgttacagctgacgctgggagatatgaaatcactgctgccaactccagtggtacaaccaaagctttcattaacattgttgtgctagacaggcctggtcctccaactggccctgttgttattagtgatataactgaagaaagtgtgactctcaaatgggagccacctaagtatgacggtggaagtcaagttaccaactacattctactcaaaagagaaacaagtactgcagtgtggactgaagtgtctgcaacagttgcaagaaccatgatgaaagtcatgaaactgaccacaggagaagaataccaattccgcatcaaggcagaaaaccgctttggcatcagtgatcatatagattcagcttgtgtgactgtcaaactaccatacacaacacctggaccaccatctacaccatgggtcactaatgttactcgagaaagcatcactgtgggctggcatgaaccagtgtcaaatggaggcagtgcagtcgtaggctatcacctggaaatgaaagacagaaacagtattttatggcaaaaagccaacaaactggtcatccgcacaactcacttcaaagtcacaacaatcagtgctggacttatttatgaattcagggtgtatgcagaaaatgctgctggagttggaaaacctagccatccttctgaaccagtcttggcaattgatgcttgtgaacccccaagaaatgttcgtatcactgatatttcaaagaactctgtcagcctttcatggcaacaaccagctttcgatggaggtagcaagattacaggctacattgttgagagacgtgaccttccagatggcagatggaccaaggccagcttcaccaatgttactgaaactcaattcatcatctctggcttgactcagaattcccagtatgaattccgtgtctttgctaggaatgctgttggttccattagcaatccatctgaggttgtagggcccattacttgcatcgattcttatggtggtcctgtaattgatttgcctctagaatatacagaagttgtcaaatacagagcaggtacatctgtgaagctcagagctggcatttctggcaaacctgcgcctactattgagtggtataaagatgataaagaattacaaaccaatgcactggtgtgtgttgaaaataccacggacctcgcatctatactcatcaaagatgccgatcgccttaatagtggatgctatgaattaaaactaaggaatgccatgggctcagcctcagccaccatcagagtacagatccttgacaaaccaggcccacctggtggaccaattgaatttaagactgtaactgctgagaagatcacccttctctggcggcctccagctgatgatggtggtgcaaaaatcactcactacattgtggaaaagcgtgagacaagccgcgttgtgtggtctatggtgtctgaacatttggaagagtgcatcattacaaccaccaaaattatcaaaggaaatgaatacatcttccgggtccgagccgtgaacaaatatggaattggcgagccactggaatctgattccgttgtagccaagaacgcatttgttacacctgggccaccaggcataccagaagtgacaaagattaccaagaattcgatgactgttgtatggagcaggccaattgcagatggcggtagtgatataagtggctatttccttgaaaaacgagacaagaagagcctaggatggtttaaagtactaaaagagactatccgtgacaccagacaaaaagtaacaggactcacagaaaacagtgactatcaatacagagtttgtgctgtaaacgctgctggacagggtccattttctgaaccatctgaattctacaaagctgctgatcctattgatcctccaggtccacctgctaagataagaatcgcagattcaaccaagtcatccatcacccttggctggagtaagcctgtctatgatgggggcagtgctgttactgggtatgttgtcgagataagacaaggagaggaagaggaatggactactgtctctaccaaaggagaggtcagaactacagaatatgtggtatccaacctgaaacctggagtcaattactacttccgggtatctgctgtaaactgtgctggacaaggagaacctatagaaatgaatgaacctgtacaagctaaagatatacttgaggcaccagagattgacctggatgtggctctcagaacttctgttattgccaaagctggtgaagatgtacaagtgttgattccctttaaaggcagacctccacctactgtcacatggagaaaagatgagaagaatcttggcagtgatgccagatacagcattgaaaacactgattcatcctcattactcaccattcctcaagttactcgcaatgatacaggaaaatatattctcacaatagaaaatggagttggtgaacctaagtcttcaactgtgagtgttaaagtgcttgacacaccagctgcctgccagaaactacaggttaaacatgtttctcgaggcacagtcactttgctctgggatcctcctctcattgatggaggatctccaataattaattatgtcattgaaaagagagatgccaccaagagaacatggtctgtcgtgtcacacaaatgttctagcacatccttcaagctaatagatttgtcggagaagactccattcttcttcagagttcttgcagaaaatgaaattggaattggggaaccctgtgaaactacagagccagtgaaggctgctgaagtaccagctcctatacgtgatctctcaatgaaagactcaacaaagacatctgtcatcctcagctggaccaaacctgactttgatggtggtagcgtcatcacagaatatgttgtagaaaggaaaggtaaaggtgaacagacgtggtcccacgctggcataagtaagacatgtgaaattgaggttagccaacttaaggagcagtcagtcctggagttcagagtgtttgccaaaaatgagaaaggactgagtgatcctgtcactattgggccaattacagtgaaagaacttattattacacctgaagttgacctgtcagatatccctggggcacaagtcactgtgagaattgggcacaatgtgcaccttgaattaccttataagggaaaacccaaaccatccatcagttggctgaaagatggcttgccactgaaagaaagtgaatttgttcgcttcagtaaaactgaaaacaaaattactttgagtattaagaatgccaagaaggagcatggaggaaaatacactgttattcttgataatgcagtgtgtagaattgcagtccccattacagtcatcacccttggcccaccatcaaagcccaaaggacccattcgatttgatgaaatcaaggctgatagtgtcatcctgtcatgggatgtacctgaagataatggaggaggagaaattacttgttacagcatcgagaagcgggaaacttcacaaactaactggaagatggtgtgttcaagtgttgccagaacgactttcaaagttcctaatctagtcaaagatgctgagtaccagtttagagtgagagcagaaaacagatacggagtcagccaaccacttgtctcaagcattattgtggcaaaacaccagttcaggattcctggtcccccaggaaagccagttatatacaatgtgacttctgatggcatgtcactaacttgggatgctccagtttatgatggtggttcagaagttactggattccatgttgaaaagaaagaaagaaatagcatcctctggcaaaaagttaatacatcaccaatctctggaagagaatatagagccactggactggtagaaggtctggattaccaattccgtgtatatgctgaaaattctgctggcctaagctcacctagtgacccaagcaaatttaccttagctgtttctccagtagacccacctggcactcctgactacattgatgtcacccgggaaaccatcacacttaaatggaacccaccattgcgtgatggaggcagtaagattgtgggctatagcattgagaaacggcaaggaaatgaacgctgggtgagatgcaactttactgacgtcagtgaatgtcagtacacagttacaggactcagtcctggggatcgctatgagttcagaataattgcaagaaatgctgttggaactataagcccgccctcacagtcttctggcattattatgacaagagatgaaaatgttccaccaatagtagagtttggccctgaatactttgatggtctcattattaagtccggagagagccttagaattaaagctttggtacaaggaagaccagtgcctcgagtaacttggttcaaagatggagtggaaatcgaaaagaggatgaatatggaaataaccgacgtacttggatccaccagcctatttgttagagatgctactcgggaccatcgtggtgtatacacagtggaagccaaaaatgcatctggttctgcaaaagcagaaattaaagtgaaagtacaagatacaccaggaaaagtagttgggccaataagattcaccaatattactggggagaagatgactctgtggtgggatgccccactcaatgacggttgtgctcccataacccactacatcattgaaaaacgggaaaccagcagacttgcctgggcactaattgaggataaatgtgaagcccaaagttacactgccattaaactaataaacggcaatgaataccaattccgtgtttctgcagttaacaagtttggtgttggcaggccacttgattctgatccagtggttgctcaaatacaatatactgttcctgatgcccctggcattccagaacctagcaacataacaggcaacagcattaccctgacatgggcaaggccagaatcagatggtggcagtgaaattcaacagtatatccttgaaagaagagaaaagaaaagcacaagatgggtaaaagtgatcagcaaacgaccaatctctgaaacaagattcaaagtcactggtctgacagaaggcaatgagtatgaattccatgtcatggctgaaaatgctgcaggagttggacctgcaagtggcatctcaagactcattaaatgtagagagcccgtcaacccaccaggtcctcccacagtggtcaaagtaacagacacatcaaagacaactgtgagcttagaatggtccaaaccagtgtttgatggtggcatggaaataattgggtatattattgaaatgtgtaaggccgacttaggagactggcacaaggtgaatgcagaggcatgtgtgaaaacaagatatacagtcactgatctacaagcaggtgaagaatacaaattccgagttagtgctatcaatggtgctggaaaaggcgacagctgtgaagtgactggcacaattaaagcagttgaccggttaacagctcctgagttagacatagatgcaaacttcaaacagactcatgttgttagagctggggccagtattcgcctcttcattgcctaccaaggtagacctactcctacagctgtgtggagcaaaccagactctaaccttagccttcgggctgatatccatacaacagattccttcagcaccctcactgtggaaaactgcaacagaaatgatgcagggaaatatacccttactgtggaaaacaacagtggtagtaagtcaatcacattcaccgtgaaagtgctagacactccaggcccacctggcccaattaccttcaaagatgtgacccggggatctgctacattgatgtgggatgcccctcttcttgacggtggtgcccgaatccatcattatgtggtagagaaacgagaggcaagtcgccgtagttggcaggttatcagtgaaaaatgcactcgtcagatcttcaaggtcaatgacctggccgaaggtgttccgtactatttccgtgtttctgcagtaaatgagtatggtgttggtgagccctatgaaatgccagaaccaattgtagccacagaacagcctgctccacctaggagacttgatgttgttgatactagcaaatcctccgcagtcttagcttggcttaaacctgaccacgatggaggcagccggatcactggctacctgcttgaaatgagacaaaagggatctgacttctgggttgaagctggtcacaccaaacagctaactttcacagtagagcgtcttgttgagaaaactgaatatgaattccgtgtgaaggccaagaatgatgctggctatagtgaacccagagaagccttctcttctgtcatcattaaggagcctcaaatcgagcccactgctgacctcactggaattaccaatcagcttataacttgcaaagcaggaagcccatttaccattgacgtaccaatcagtggtcgtcctgcccccaaagtaacatggaaactggaagaaatgagacttaaagagacagatcgagtgagcattacaacaacaaaagacagaaccacactgactgtaaaggacagcatgagaggtgactctggaagatacttcttgaccctggaaaatacagctggtgttaaaacatttagcgtcacagttgtggtcattggaaggccaggtccagtaaccggccccattgaggtctcatctgtctcagctgaatcgtgtgtcctgtcatggggagaacctaaagatggaggaggcactgaaattactaattacatagttgaaaagcgtgaatcgggtacaacagcttggcagcttgtcaattccagtgtcaagcgcactcaaattaaagtcactcatctcacaaaatacatggaatattctttccgtgtcagttcagagaacagatttggtgtcagcaaacctctagaatcagcaccaataattgctgaacatccatttgtcccaccaagcgctcctaccagacctgaggtctaccatgtgtctgccaatgccatgtctattcgttgggaagaaccctaccacgatggtggcagtaaaatcattggctactgggttgagaagaaagaacgtaatacaattctttgggtgaaagaaaacaaagtgccatgcttagagtgcaactacaaagtaactggtttagtagaaggactggaatatcagttcagaacttatgcactcaatgctgcaggtgttagcaaggccagcgaagcttcaagacctataatggctcaaaatccagttgatgcaccaggcagaccagaggtgacagatgtcacaagatcaacagtatcactgatttggtctgccccagcgtatgatggaggcagcaaggttgtgggctacatcatagagcgtaagccagtcagtgaggtaggagatggtcgctggctgaagtgcaactacaccattgtatctgacaatttcttcaccgtgactgctctcagtgaaggagacacttatgagttccgtgtgttagccaagaatgcagcaggcgtaattagcaaagggtctgaatctacaggccctgtcacttgccgagatgaatacgctccacccaaagccgaactggatgcccgattacacggtgatctggttaccatcagagcaggttctgatcttgttctggatgctgcagttggtggcaaacctgaacccaaaattatctggaccaaaggagacaaggagctagatctctgtgaaaaagtctctttgcagtatactggcaaacgagcaactgctgtgatcaagttctgtgacagaagtgacagtggaaaatacactttaacagtgaaaaatgccagcgggaccaaggccgtgtctgtcatggtcaaagtgcttgattcccctggcccatgtggaaagctcaccgtcagcagagtaacacaggagaagtgcactttagcctggagccttccgcaggaagacggaggagcagaaatcactcactacatcgtggaaagacgcgagactagcaggctcaactgggtgattgttgaaggcgaatgcccaaccctatcctatgtcgttaccaggctcatcaagaacaatgagtacatattccgagtgagggcagtaaacaaatatggccctggtgtgcctgttgaatcagagccaattgtagccagaaactcattcactattccatcaccacccggcatacctgaagaagttgggactggcaaagagcatatcatcattcagtggacaaaacctgaatctgatggtggcaatgaaatcagcaactacctagtagacaaacgtgagaagaagagcctgcgctggacacgtgtcaacaaagactatgtggtgtatgataccaggctgaaggtgaccagcctgatggagggttgtgattaccagttccgggtgaccgcagtgaatgcagctggtaacagtgagcccagcgaagcttccaacttcatctcatgcagagaaccatcatatacccctggaccaccttctgctccaagagttgtggataccaccaaacacagcattagtttggcatggaccaaacccatgtacgatggtggtactgacattgtaggatatgttctggaaatgcaagagaaggacactgatcagtggtaccgagtgcataccaatgccacaataagaaatactgaattcactgtgccagaccttaaaatgggccagaaatattccttcagagttgctgccgtgaacgtgaagggtatgagcgaatacagcgaatcaattgctgaaattgagcccgtggaaagaatagaaataccagatcttgagcttgcagatgatctaaagaagactgtgaccatcagggctggggcctccttgcgcttgatggtgtctgtatctggaagaccacctcctgtcataacgtggagcaagcagggcattgaccttgcaagccgggcaattattgacaccactgagagctactcattgctaatagtggacaaagttaatcggtacgatgctggaaaatacacaattgaagctgaaaaccaatctggcaagaaatcagcaacagtccttgttaaagtctatgatactcctggtccctgtccttcagtgaaagttaaggaagtatcaagagattctgtgactataacttgggaaattcccacgattgatggtggagctccagtcaacaattacatcgttgagaagcgtgaagctgctatgagagcattcaaaacagtaactaccaaatgcagcaagacactttacagaatttctggacttgtagaaggaaccatgtactatttcagagtgctgccagaaaatatttatggcattggagaaccttgtgaaacatctgatgcagtactggtctcagaagtgcctttggtgcctgcaaagctagaagtggtcgatgtcaccaaatccactgttacccttgcctgggaaaaaccactctacgatggtggtagccgactcactggatatgttctcgaggcctgcaaagctggcacagagagatggatgaaggttgtcaccttaaaacccacagtcctagagcacactgttacttccttaaatgaaggtgaacaatacttatttagaataagggcacaaaatgagaaaggtgtgtcagaaccaagagagactgtcacagccgtgactgtacaagacctcagagtgttgccaacaatcgatctttctacaatgcctcagaagaccatccatgtcccagctggcagaccagtagagctggtgatacctattgctggccgtccacctcctgctgcttcctggttctttgctggttctaaactgagagaatcagagcgtgtcacagttgaaactcacactaaagtagctaaattaaccatccgtgaaaccactatcagagatactggagaatacacacttgaattgaagaatgttaccggaactacttcagaaaccattaaagttatcattcttgacaagcctggtccaccaacaggacctattaagattgatgaaattgatgctacatcaattaccatttcctgggaaccacctgaattggacggtggtgctccactgagtggttatgtggtagaacaacgtgacgctcatcgtccaggatggctgcccgtttctgaatcagtgactaggtccacgtttaagtttaccagactcaccgaaggaaatgagtatgtgttccgtgtggctgcaacaaaccgcttcgggattggctcttacttgcagtctgaggtcatagagtgtcgcagcagcatccgtattcctggacccccagaaacattacagatatttgatgtttcccgtgatggcatgacacttacttggtacccaccagaggatgacggtggctcccaagtgactggatatattgtggagcgcaaagaagtgagagcagatcgatgggtccgtgtaaataaagtacctgtgacaatgacacggtaccgctccactggccttactgaaggcttagaatatgaacaccgtgtcacagccattaatgcaagagggtctgggaaaccaagtcgtccttccaaacccatcgttgccatggatccaattgctcctccaggaaagccacaaaacccaagagttactgatacaacaaggacatcagtctccctggcctggagtgttccagaagatgaaggaggatctaaagtcacaggctacttgattgaaatgcaaaaagtagatcaacatgaatggaccaagtgtaacaccactccaaccaagattcgagagtatactctaacacacctacctcagggtgcagaatacaggttccgcgtcctagcttgtaatgctggtggacctggtgagcctgctgaggtaccaggaacagtcaaagtcactgaaatgcttgaatatcctgattatgaacttgatgaaagataccaagaaggtatctttgtaaggcaaggtggcgtcatcagacttaccataccaatcaaaggaaaaccattcccaatatgtaaatggaccaaggaaggccaggatattagtaagcgtgccatgattgcaacatctgaaacacacactgagcttgtgatcaaagaagcagacaggggtgattctggcacttatgacctggttctggaaaataaatgtggcaagaaggctgtctacatcaaggtcagggtgataggaagtcccaacagtccagaagggccactggaatatgatgacatccaagtccgctctgtgagggtcagctggagacctcctgctgatgatggtggtgctgacatcttaggctacatcctcgagagacgagaagtgcctaaagccgcctggtataccattgattccagagtccgaggtacatctctggtggtaaaaggcctcaaagagaatgtagaataccatttccgtgtttcagcagaaaaccagtttggcataagcaaacccttgaaatctgaggaaccagtcacaccaaaaacaccattgaatcctccagaacctccaagcaatcctccagaagtactcgatgtaaccaagagttctgttagcttgtcctggtcccggcccaaagatgatggtggttctagagtcacaggctactacatcgaacgcaaagagacatccactgacaagtgggtcagacacaacaagactcagatcaccaccacaatgtacactgtcacagggcttgttcccgatgctgagtatcagttccgcatcatcgcacagaatgatgttggcctgagtgagaccagccctgcttctgaaccagttgtttgcaaagatccatttgataaaccaagccaaccaggagaacttgagattctttcaatatccaaagatagtgtcactctacagtgggagaaacctgaatgtgatggtggtaaagaaattcttggatactgggttgaatatagacagtctggagacagtgcctggaagaagagcaataaggaacgtattaaggacaagcaattcacaataggaggtttgctggaagctactgagtatgaattcagggtttttgctgagaatgagactgggctgagcagacctcgcagaactgctatgtctataaagactaaactcacatctggagaggccccaggaatacgcaaagaaatgaaggatgttaccacaaaattgggtgaagctgctcaactctcatgccagattgttggaaggcctcttcctgacattaaatggtacagatttggtaaagagctcatacaaagccggaaatacaaaatgtcttcagatggacgcacacacactcttacagtaatgacagaggaacaggaagatgaaggtgtttatacctgcatagccaccaatgaggttggagaagtagaaaccagtagtaagcttctcctgcaagcaacaccgcagttccatcctggttacccactgaaagagaaatattatggagctgtgggttccacacttcggcttcatgttatgtacattggtcgtccagtacctgccatgacttggttccatggtcagaaacttttgcaaaactcagaaaacattactattgaaaacactgagcactatactcatcttgtcatgaagaatgtccaacgtaagactcatgctgggaaatacaaagtccagctcagcaatgtttttggaacagttgatgccatccttgatgtggaaatacaagataaaccagacaaacctacaggaccaattgtgatcgaagctctattgaagaactccgcagtgatcagctggaaaccacccgcagatgacggaggctcctggatcaccaactatgtggtggaaaaatgtgaggccaaggagggggctgaatggcaattggtgtcttcagccatctcagtgacaacctgtagaattgtgaacctcacagaaaatgctggctattacttccgggtttcagctcagaacactttcggcatcagtgaccctctagaagtgtcctcagttgtgatcattaagagtccatttgaaaagccaggtgctcctggcaaaccaactattactgctgtcacaaaagattcttgtgttgtggcctggaagccacctgccagtgatggaggtgcaaagattagaaattactaccttgagaagcgtgagaagaagcagaataaatggatttctgtgacaacagaagaaattcgagaaactgtcttttcagtgaaaaaccttattgaaggtcttgaatacgagtttcgtgtgaaatgtgaaaatctaggtggggaaagtgaatggagtgaaatatcagaacccatcactcccaaatctgatgtcccaattcaggcaccacactttaaagaggaactgagaaatctaaatgtcagatatcagagcaatgctaccttggtctgcaaagtgactggtcatccaaaacctatcgtcaaatggtacagacaaggcaaagaaatcattgcagatggattaaaatataggattcaagaatttaagggtggctaccaccagctcatcattgcaagtgtcacagatgatgatgccacagtttaccaagtcagagctaccaaccaagggggatctgtgtctggcactgcctccttggaagtggaagttccagctaagatacacttacctaaaactcttgaaggcatgggagcagttcatgctctccgaggtgaagtggtcagcatcaagattcctttcagtggcaaaccagatcctgtgatcacctggcagaaaggacaagatctcattgacaataatggccactaccaagttattgtcacaagatccttcacatcacttgttttccccaatggggtagagagaaaagatgctggtttctatgtggtctgtgctaaaaacagatttggaattgatcagaagacagttgaactggatgtggctgatgttcctgacccacccagaggagtcaaagttagtgatgtctcacgagattctgtcaacttaacatggactgagccagcctctgatggtggcagcaaaatcaccaactacattgttgaaaaatgtgcaactactgcagaaagatggctccgtgtaggacaggcccgagaaacacgttataccgtgatcaacttatttggaaaaacaagttaccagttccgggtaatagctgaaaataaatttggtctgagcaagccttcagagccttcagaaccaaccataaccaaagaagataagaccagagctatgaactatgatgaagaggtagatgaaaccagggaagtctccatgactaaagcatctcactcttcaaccaaggaactctatgagaaatatatgattgctgaagatcttgggcgtggtgagtttggaattgtccatcgttgtgttgaaacatcctcaaagaagacatacatggccaaatttgttaaagtcaaagggactgatcaggttttggtaaagaaggaaatttccattctgaatattgctaggcatagaaacatcttacacctccatgaatcatttgaaagcatggaagaattagttatgatctttgagtttatatcaggacttgacatatttgagcgcattaacacaagtgcttttgaacttaatgaaagagaaattgtaagttatgttcaccaggtctgtgaagcacttcagtttttacacagtcataatattggacactttgacattagaccagaaaatatcatttaccaaaccagaagaagctctaccattaaaatcatagaatttggtcaagcccgtcagctgaaaccaggggacaacttcaggcttctattcactgccccagaatactatgcacctgaagtccaccagcatgatgttgtcagcacagccacagacatgtggtcacttggaacactggtatatgtgctattgagtggtatcaacccattcctggctgaaactaaccaacagatcattgagaatatcatgaatgctgaatatactttcgatgaggaagcattcaaagagattagcattgaagccatggattttgttgaccggttgttagtgaaagagaggaaatctcgcatgacagcatcggaggctctccagcacccatggttgaagcagaagatagaaagagtcagtactaaagttatcagaacattaaaacaccggcgttattaccacaccctgatcaagaaagacctcaacatggttgtgtcagcagcccggatctcctgtggtggtgcaattcgatctcagaagggagtgagtgttgctaaagttaaagtggcatccattgaaattggcccagtttctgggcagataatgcatgcagttggtgaagaaggaggacatgtcaaatatgtatgcaaaattgaaaattatgatcagtctacccaagtgacttggtactttggcgtccgacagctggagaacagtgagaaatacgaaatcacctacgaagatggagtggccatcctctatgtcaaagacattaccaaattagatgatggtacctacagatgcaaagtagtcaatgactatggtgaagacagttcttatgcagagctatttgttaaaggtgtgagagaagtctatgactattactgccgtagaaccatgaagaaaattaagcgcagaacagacacaatgagactcctggaaaggccaccagaatttaccctgcctctctataataagacagcttatgtaggtgaaaatgtccggtttggagtaactataactgtccacccagagcctcatgtaacatggtataaatcaggtcagaaaatcaaaccaggtgacaatgacaagaagtacacatttgagtcagacaagggtctttaccaattaacaatcaacagtgtcactacagatgatgacgctgaatatactgttgtggcaaggaacaaatatggtgaagacagctgtaaagcaaagctgacagtaaccctacacccacctccaacagatagtaccttaagacccatgttcaaaaggttactggcaaatgcagaatgccaagaaggccaaagtgtctgctttgagatcagagtgtctggcatccccccaccaacattaaaatgggagaaagatggtcagccactgtccctcgggcctaacattgaaattatccatgaaggcttggattattatgctctgcacatcagggacactttgcctgaagacacgggttattatagagtcacagccactaacacagctgggtccaccagctgccaggctcacctacaagtggaacgcctgaggtacaagaaacaggaattcaagagtaaggaggagcatgagcgacacgtacaaaaacaaattgacaaaaccctcagaatggctgaaattctttctggaactgaaagtgtaccactgacacaggtagctaaagaggctctgagagaagctgctgtcctttataaaccggctgtaagcaccaagactgtaaaaggggaattcagacttgagatagaagaaaagaaggaggagagaaaactccggatgccttatgatgtaccagagccacgcaagtataagcagactaccatagaagaagaccaacgcatcaagcagttcgtgcccatgtctgacatgaagtggtataaaaagatacgtgatcagtatgaaatgcctgggaaacttgacagagttgtacagaaacgacccaagcgcatccgcctttcaagatgggaacagttctatgtgatgcctcttccacgcattacagatcaatacagacctaaatggcgtattcctaaactgtcccaagatgatcttgagatagtgagaccagcccgccggcgtacaccttctcctgattatgacttttactaccgacctagaagacgttctcttggggacatctctgatgaagaattactcctccccattgatgactacttagcaatgaaaagaacagaggaagagaggctgcgtcttgaagaagagcttgagttaggtttttcagcttcacccccaagtcgaagccctccacactttgagctttctagcctacgttactcttcaccacaagctcatgtcaaggtggaggaaacaagaaaagacttcaggtattcaacctatcacatcccaacgaaggctgaagctagtacaagttatgcagaactgagggaacggcatgcccaggctgcgtacagacagccaaagcaacggcaaagaatcatggctgagagggaggatgaagagttgcttcgcccagttacgaccacccagcatctctcagaatacaaaagcgaacttgacttcatgtcaaaggaggaaaagtctagaaagaaatcaaggcgacaaagagaagtgacagaaataacagaaattgaggaagaatacgaaatctcaaaacatgctcaaagagaatcatcctcatctgcgtctagactactgagacgacggcgctccctgtctccaacttatattgagttaatgaggccagtgtctgagctgatccggtcacgtccacaaccggctgaggaatacgaagatgacacagaaagaaggtcacctactccagagagaactcgcccacgatcccccagccctgtgtctagtgagagatcactctcgagatttgagaggtctgcaagatttgatatcttttccaggtatgagtccatgaaagctgctttaaaaactcagaagacatcagaaaggaagtatgaagttttgagtcagcagcctttcacactggaccatgcccctcgaatcacactgagaatgcgctcgcacagggtaccatgtggccaaaatacacgttttattttaaatgttcagtctaagccaactgccgaggttaaatggtaccacaatggtgtggaactccaagaaagcagtaagattcattacaccaacacgagtggagtcctcaccctggaaattctggactgtcatactgatgacagtggaacctaccgtgctgtgtgcaccaactacaagggcgaagcttctgactatgcaacgttggacgtgacaggaggggattataccacctatgcttcccaacgcagagatgaagaggtccccagatctgttttccctgagctgacaagaacagaggcgtatgctgtttcatcatttaagaaaacatctgagatggaagcttcgtcttctgtcagggaagtgaaatcacagatgacggagacaagggaaagtctctcctcatatgaacactctgcatctgcagaaatgaaaagtgctgcattagaagaaaagtcactggaagaaaaatccacaaccagaaagatcaagacgactttggcagcaagaattctaacaaagccacggtccatgaccgtctacgagggcgagtctgcaaggttttcttgtgacaccgatggtgagccggtaccaactgtgacctggctgcgtaaaggacaagtgctaagtacttctgcccgccaccaagtgaccaccacaaagtacaaatcaacctttgagatctcttcagtccaggcttccgatgagggcaattacagcgtggtggtagaaaacagtgaagggaaacaagaagcagagttcactctgactattcaaaaggccagggtaactgaaaaggctgtgacatcaccaccaagagtcaaatccccagagcctcgggtgaaatccccagaagcagttaagtctccaaaacgagtgaaatctccagaaccttctcacccgaaagccgtatcacccacagagacaaaaccaacaccaacagagaaagttcagcacctcccagtctctgccccaccaaagattactcagttcctgaaagcagaagcttctaaagagattgcaaaactgacctgtgtggttgaaagcagtgtattaagggcaaaagaggtcacctggtataaagatggcaagaaactgaaggaaaatgggcatttccagtttcattattcagcagatggtacctatgagctcaaaatcaataacctcactgaatctgatcaaggagaatatgtttgtgagatttctggtgaaggtggaacgtctaaaaccaacttacaatttatggggcaagcctttaagagtatccatgagaaggtatcaaaaatatcagaaactaagaaatcagatcagaaaaccactgagtcaacagtaaccagaaaaactgaaccaaaagctcctgaaccaatttcctcaaaaccagtaattgttactgggttgcaggatacaactgtttcttcagacagtgttgctaaatttgcagttaaggctactggagaaccccggccaactgccatctggacaaaagatggaaaggccattacacaaggaggtaaatataaactctctgaagacaagggagggttcttcttagaaattcataagactgatacttctgacagtggactttatacttgtacagtaaaaaattcagctggatctgtgtcctctagctgcaaattaacaataaaagctataaaagatactgaggcacagaaagtctctacacaaaagacttctgaaattacacctcagaagaaagctgttgtccaagaggaaatttcccaaaaagccctaaggtctgaagaaattaagatgtcagaggcaaaatctcaagaaaagttagccctcaaagaggaagcttcaaaggttctgatttctgaagaagtcaagaaatcagcagcaacctccctggaaaaatccattgtccatgaggaaatcactaaaacatcacaggcatcagaagaagtcagaactcatgctgagattaaagcattttctactcagatgagcataaacgaaggtcaaagactggttttaaaagccaacattgctggtgccactgatgtgaaatgggtactgaatggcgtagagcttaccaactctgaggagtaccgatatggtgtctcaggcagcgatcagaccctaaccatcaagcaagccagtcacagagatgaaggaatcctcacctgcataagcaaaaccaaggaaggaatcgtcaagtgtcagtatgatttgacactgagcaaagaactctcagatgctccagccttcatctcacagcctagatctcaaaatattaatgaaggacaaaatgttctctttacttgtgaaatcagtggcgagccatcccctgaaatcgaatggtttaaaaacaacctgccaatttctatttcttcaaatgtcagcataagccgctccagaaatgtatactcccttgaaatccgaaatgcatcagtcagcgacagtggaaagtacacaattaaggccaaaaatttccgtggccagtgttcagctacagcttccttaatggtccttcctctagttgaagaaccttccagagaggtagtattgagaacaagtggtgacacaagcttgcaaggaagcttctcgtctcagtcagtccaaatgtctgcctccaagcaggaggcctccttcagcagtttcagcagcagcagtgctagcagcatgactgagatgaaatttgcaagcatgtctgcccaaagcatgtcctccatgcaagagtcctttgtagaaatgagttccagcagctttatgggaatatctaatatgacacaactggaaagctcaactagtaaaatgcttaaagcaggcataagaggaattccgcctaaaattgaagctcttccatctgatatcagcattgatgaaggcaaagttctaacagtagcctgtgctttcacgggtgagcctaccccagaagtaacatggtcctgtggtggaagaaaaatccacagtcaagaacaggggaggttccacattgaaaacacagatgacctgacaaccctgatcatcatggacgtacagaaacaagatggtggactttataccctgagtttagggaatgaatttggatctgactctgccactgtgaatatacatattcgatccatttaagagggcctgtgcccttatactctacactcattcttaacttttcgcaaacgtttcacacggactaatctttctgaactgtaaatatttaaagaaaaaaaagtagttttgtatcaacctaaatgagtcaaagttcaaaaatattcatttcaatcttttcataattgttgacctaagaatataatacatttgctagtgacatgtacatactgtatatagccggattaacggttataaagttttgtaccatttattttatgacattttacaatgtaagttttgaaactaactgttggtaggagaaagtttcttatggaacgaataccctgctcaacatttaatcaatctttgtgcctcaacatactgttgatgtctaagtatgcctcagtgggttgagaaaatccccattgaagatgtcctgtccacctaaaagagaatgatgctgtgcatatcacttgatatgtgcaccaatacctactgaatcagaaatgtaaggcattggtgatgtttgcatttaccctcctgtaagcaacactttaacgtcttacattttctctgatgatgtcacacaaaattatcatgacaaatattaccagagcaaagtgtaacggccaacactttgttcgctcattttacgctgtctctgacataaggagtgcctgaatagcttggaaaagtaacatctcctggccatcccttcatttaaccaagctattcaagtattcctatgccagagcagtgccaactcttggaggtcccagagtgcagccaatgcctttgtgtggtagttctaaattttaattgcacctgaaaaacctgggcacctaagcaatgagccacagcaaaaagtaaagaacaacaacaaaataaagctgttgttaaattttaaacaatattactaattgcccaaaatgtcaatttgatgtagttcttttcatgcaagtataaattcaattgttagttataattgttggacctccttgagatagtaacaacaaaataaagcaagctatctgcacctcaaaa

SEQ ID NO: 2 - protein, 34350 aa, Homo sapiens
MTTQAPTFTQPLQSVVVLEGSTATFEAHISGFPVPEVSWFRDGQVISTSTLPGVQISFSDGRAKLTIPAVTKANSGRYSLKATNGSGQATSTAELLVKAETAPPNFVQRLQSMTVRQGSQVRLQVRVTGIPTPVVKFYRDGAEIQSSLDFQISQEGDLYSLLIAEAYPEDSGTYSVNATNSVGRATSTAELLVQGEEEVPAKKTKTIVSTAQISESRQTRIEKKIEAHFDARSIATVEMVIDGAAGQQLPHKTPPRIPPKPKSRSPTPPSIAAKAQLARQQSPSPIRHSPSPVRHVRAPTPSPVRSVSPAARISTSPIRSVRSPLLMRKTQASTVATGPEVPPPWKQEGYVASSSEAEMRETTLTTSTQIRTEERWEGRYGVQEQVTISGAAGAAASVSASASYAAEAVATGAKEVKQDADKSAAVATVVAAVDMARVREPVISAVEQTAQRTTTTAVHIQPAQEQVRKEAEKTAVTKVVVAADKAKEQELKSRTKEVITTKQEQMHVTHEQIRKETEKTFVPKVVISAAKAKEQETRISEEITKKQKQVTQEAIRQETEITAASMVVVATAKSTKLETVPGAQEETTTQQDQMHLSYEKIMKETRKTVVPKVIVATPKVKEQDLVSRGREGITTKREQVQITQEKMRKEAEKTALSTIAVATAKAKEQETILRTRETMATRQEQIQVTHGKVDVGKKAEAVATVVAAVDQARVREPREPGHLEESYAQQTTLEYGYKERISAAKVAEPPQRPASEPHVVPKAVKPRVIQAPSETHIKTTDQKGMHISSQIKKTTDLTTERLVHVDKRPRTASPHFTVSKISVPKTEHGYEASIAGSAIATLQKELSATSSAQKITKSVKAPTVKPSETRVRAEPTPLPQFPFADTPDTYKSEAGVEVKKEVGVSITGTTVREERFEVLHGREAKVTETARVPAPVEIPVTPPTLVSGLKNVTVIEGESVTLECHISGYPSPTVTWYREDYQIESSIDFQITFQSGIARLMIREAFAEDSGRFTCSAVNEAGTVSTSCYLAVQVSEEFEKETTAVTEKFTTEEKRFVESRDVVMTDTSLTEEQAGPGEPAAPYFITKPVVQKLVEGGSVVFGCQVGGNPKPHVYWKKSGVPLTTGYRYKVSYNKQTGECKLVISMTFADDAGEYTIVVRNKHGETSASASLLEEADYELLMKSQQEMLYQTQVTAFVQEPKVGETAPGFVYSEYEKEYEKEQALIRKKMAKDTVVVRTYVEDQEFHISSFEERLIKEIEYRIIKTTLEELLEEDGEEKMAVDISESEAVESGFDSRIKNYRILEGMGVTFHCKMSGYPLPKIAWYKDGKRIKHGERYQMDFLQDGRASLRIPVVLPEDEGIYTAFASNIKGNAICSGKLYVEPAAPLGAPTYIPTLEPVSRIRSLSPRSVSRSPIRMSPARMSPARMSPARMSPARMSPGRRLEETDESQLERLYKPVFVLKPVSFKCLEGQTARFDLKVVGRPMPETFWFHDGQQIVNDYTHKVVIKEDGTQSLIIVPATPSDSGEWTVVAQNRAGRSSISVILTVEAVEHQVKPMFVEKLKNVNIKEGSRLEMKVRATGNPNPDIVWLKNSDIIVPHKYPKIRIEGTKGEAALKIDSTVSQDSAWYTATAINKAGRDTTRCKVNVEVEFAEPEPERKLIIPRGTYRAKEIAAPELEPLHLRYGQEQWEEGDLYDKEKQQKPFFKKKLTSLRLKRFGPAHFECRLTPIGDPTMVVEWLHDGKPLEAANRLRMINEFGYCSLDYGVAYSRDSGIITCRATNKYGTDHTSATLIVKDEKSLVEESQLPEGRKGLQRIEELERMAHEGALTGVTTDQKEKQKPDIVLYPEPVRVLEGETARFRCRVTGYPQPKVNWYLNGQLIRKSKRFRVRYDGIHYLDIVDCKSYDTGEVKVTAENPEGVIEHKVKLEIQQREDFRSVLRRAPEPRPEFHVHEPGKLQFEVQKVDRPVDTTETKEVVKLKRAERITHEKVPEESEELRSKFKRRTEEGYYEAITAVELKSRKKDESYEELLRKTKDELLHWTKELTEEEKKALAEEGKITIPTFKPDKIELSPSMEAPKIFERIQSQTVGQGSDAHFRVRVVGKPDPECEWYKNGVKIERSDRIYWYWPEDNVCELVIRDVTAEDSASIMVKAINIAGETSSHAFLLVQAKQLITFTQELQDVVAKEKDTMATFECETSEPFVKVKWYKDGMEVHEGDKYRMHSDRKVHFLSILTIDTSDAEDYSCVLVEDENVKTTAKLIVEGAVVEFVKELQDIEVPESYSGELECIVSPENIEGKWYHNDVELKSNGKYTITSRRGRQNLTVKDVTKEDQGEYSFVIDGKKTTCKLKMKPRPIAILQGLSDQKVCEGDIVQLEVKVSLESVEGVWMKDGQEVQPSDRVHIVIDKQSHMLLIEDMTKEDAGNYSFTIPALGLSTSGRVSVYSVDVITPLKDVNVIEGTKAVLECKVSVPDVTSVKWYLNDEQIKPDDRVQAIVKGTKQRLVINRTHASDEGPYKLIVGRVETNCNLSVEKIKIIRGLRDLTCTETQNVVFEVELSHSGIDVLWNFKDKEIKPSSKYKIEAHGKIYKLTVLNMMKDDEGKYTFYAGENMTSGKLTVAGGAISKPLTDQTVAESQEAVFECEVANPDSKGEWLRDGKHLPLTNNIRSESDGHKRRLIIAATKLDDIGEYTYKVATSKTSAKLKVEAVKIKKTLKNLTVTETQDAVFTVELTHPNVKGVQWIKNGVVLESNEKYAISVKGTIYSLRIKNCAIVDESVYGFRLGRLGASARLHVETVKIIKKPKDVTALENATVAFEVSVSHDTVPVKWFHKSVEIKPSDKHRLVSERKVHKLMLQNISPSDAGEYTAVVGQLECKAKLFVETLHITKTMKNIEVPETKTASFECEVSHFNVPSMWLKNGVEIEMSEKFKIVVQGKLHQLIIMNTSTEDSAEYTFVCGNDQVSATLTVTPIMITSMLKDINAEEKDTITFEVTVNYEGISYKWLKNGVEIKSTDKCQMRTKKLTHSLNIRNVHFGDAADYTFVAGKATSTATLYVEARHIEFRKHIKDIKVLEKKRAMFECEVSEPDITVQWMKDDQELQITDRIKIQKEKYVHRLLIPSTRMSDAGKYTVVAGGNVSTAKLFVEGRDVRIRSIKKEVQVIEKQRAVVEFEVNEDDVDAHWYKDGIEINFQVQERHKYVVERRIHRMFISETRQSDAGEYTFVAGRNRSSVTLYVNAPEPPQVLQELQPVTVQSGKPARFCAVISGRPQPKISWYKEEQLLSTGFKCKFLHDGQEYTLLLIEAFPEDAAVYTCEAKNDYGVATTSASLSVEVPEVVSPDQEMPVYPPAIITPLQDTVTSEGQPARFQCRVSGTDLKVSWYSKDKKIKPSRFFRMTQFEDTYQLEIAEAYPEDEGTYTFVASNAVGQVSSTANLSLEAPESILHERIEQEIEMEMKEFSSSFLSAEEEGLHSAELQLSKINETLELLSESPVYSTKFDSEKEGTGPIFIKEVSNADISMGDVATLSVTVIGIPKPKIQWFFNGVLLTPSADYKFVFDGDDHSLIILFTKLEDEGEYTCMASNDYGKTICSAYLKINSKGEGHKDTETESAVAKSLEKLGGPCPPHFLKELKPIRCAQGLPAIFEYTVVGEPAPTVTWFKENKQLCTSVYYTIIHNPNGSGTFIVNDPQREDSGLYICKAENMLGESTCAAELLVLLEDTDMTDTPCKAKSTPEAPEDFPQTPLKGPAVEALDSEQEIATFVKDTILKAALITEENQQLSYEHIAKANELSSQLPLGAQELQSILEQDKLTPESTREFLCINGSIHFQPLKEPSPNLQLQIVQSQKTFSKEGILMPEEPETQAVLSDTEKIFPSAMSIEQINSLTVEPLKTLLAEPEGNYPQSSIEPPMHSYLTSVAEEVLSPKEKTVSDTNREQRVTLQKQEAQSALILSQSLAEGHVESLQSPDVMISQVNYEPLVPSEHSCTEGGKILIESANPLENAGQDSAVRIEEGKSLRFPLALEEKQVLLKEEHSDNVVMPPDQIIESKREPVAIKKVQEVQGRDLLSKESLLSGIPEEQRLNLKIQICRALQAAVASEQPGLFSEWLRNIEKVEVEAVNITQEPRHIMCMYLVTSAKSVTEEVTIIIEDVDPQMANLKMELRDALCAIIYEEIDILTAEGPRIQQGAKTSLQEEMDSFSGSQKVEPITEPEVESKYLISTEEVSYFNVQSRVKYLDATPVTKGVASAVVSDEKQDESLKPSEEKEESSSESGTEEVATVKIQEAEGGLIKEDGPMIHTPLVDTVSEEGDIVHLTTSITNAKEVNWYFENKLVPSDEKFKCLQDQNTYTLVIDKVNTEDHQGEYVCEALNDSGKTATSAKLTVVKRAAPVIKRKIEPLEVALGHLAKFTCEIQSAPNVRFQWFKAGREIYESDKCSIRSSKYISSLEILRTQVVDCGEYTCKASNEYGSVSCTATLTVTEAYPPTFLSRPKSLTTFVGKAAKFICTVTGTPVIETIWQKDGAALSPSPNWKISDAENKHILELSNLTIQDRGVYSCKASNKFGADICQAELIIIDKPHFIKELEPVQSAINKKVHLECQVDEDRKVTVTWSKDGQKLPPGKDYKICFEDKIATLEIPLAKLKDSGTYVCTASNEAGSSSCSATVTVREPPSFVKKVDPSYLMLPGESARLHCKLKGSPVIQVTWFKNNKELSESNTVRMYFVNSEAILDITDVKVEDSGSYSCEAVNDVGSDSCSTEIVIKEPPSFIKTLEPADIVRGTNALLQCEVSGTGPFEISWFKDKKQIRSSKKYRLFSQKSLVCLEIFSFNSADVGEYECVVANEVGKCGCMATHLLKEPPTFVKKVDDLIALGGQTVTLQAAVRGSEPISVTWMKGQEVIREDGKIKMSFSNGVAVLIIPDVQISFGGKYTCLAENEAGSQTSVGELIVKEPAKIIERAELIQVTAGDPATLEYTVAGTPELKPKWYKDGRPLVASKKYRISFKNNVAQLKFYSAELHDSGQYTFEISNEVGSSSCETTFTVLDRDIAPFFTKPLRNVDSVVNGTCRLDCKIAGSLPMRVSWFKDGKEIAASDRYRIAFVEGTASLEIIRVDMNDAGNFTCRATNSVGSKDSSGALIVQEPPSFVTKPGSKDVLPGSAVCLKSTFQGSTPLTIRWFKGNKELVSGGSCYITKEALESSLELYLVKTSDSGTYTCKVSNVAGGVECSANLFVKEPATFVEKLEPSQLLKKGDATQLACKVTGTPPIKITWFANDREIKESSKHRMSFVESTAVLRLTDVGIEDSGEYMCEAQNEAGSDHCSSIVIVKESPYFTKEFKPIEVLKEYDVMLLAEVAGTPPFEITWFKDNTILRSGRKYKTFIQDHLVSLQILKFVAADAGEYQCRVTNEVGSSICSARVTLREPPSFIKKIESTSSLRGGTAAFQATLKGSLPITVTWLKDSDEITEDDNIRMTFENNVASLYLSGIEVKHDGKYVCQAKNDAGIQRCSALLSVKEPATITEEAVSIDVTQGDPATLQVKFSGTKEITAKWFKDGQELTLGSKYKISVTDTVSILKIISTEKKDSGEYTFEVQNDVGRSSCKARINVLDLIIPPSFTKKLKKMDSIKGSFIDLECIVAGSHPISIQWFKDDQEISASEKYKFSFHDNTAFLEISQLEGTDSGTYTCSATNKAGHNQCSGHLTVKEPPYFVEKPQSQDVNPNTRVQLKALVGGTAPMTIKWFKDNKELHSGAARSVWKDDTSTSLELFAAKATDSGTYICQLSNDVGTATSKATLFVKEPPQFIKKPSPVLVLRNGQSTTFECQITGTPKIRVSWYLDGNEITAIQKHGISFIDGLATFQISGARVENSGTYVCEARNDAGTASCSIELKVKEPPTFIRELKPVEVVKYSDVELECEVTGTPPFEVTWLKNNREIRSSKKYTLTDRVSVFNLHITKCDPSDTGEYQCIVSNEGGSCSCSTRVALKEPPSFIKKIENTTTVLKSSATFQSTVAGSPPISITWLKDDQILDEDDNVYISFVDSVATLQIRSVDNGHSGRYTCQAKNESGVERCYAFLLVQEPAQIVEKAKSVDVTEKDPMTLECVVAGTPELKVKWLKDGKQIVPSRYFSMSFENNVASFRIQSVMKQDSGQYTFKVENDFGSSSCDAYLRVLDQNIPPSFTKKLTKMDKVLGSSIHMECKVSGSLPISAQWFKDGKEISTSAKYRLVCHERSVSLEVNNLELEDTANYTCKVSNVAGDDACSGILTVKEPPSFLVKPGRQQAIPDSTVEFKAILKGTPPFKIKWFKDDVELVSGPKCFIGLEGSTSFLNLYSVDASKTGQYTCHVTNDVGSDSCTTMLLVTEPPKFVKKLEASKIVKAGDSSRLECKIAGSPEIRVVWFRNEHELPASDKYRMTFIDSVAVIQMNNLSTEDSGDFICEAQNPAGSTSCSTKVIVKEPPVFSSFPPIVETLKNAEVSLECELSGTPPFEVVWYKDKRQLRSSKKYKIASKNFHTSIHILNVDTSDIGEYHCKAQNEVGSDTCVCTVKLKEPPRFVSKLNSLTVVAGEPAELQASIEGAQPIFVQWLKEKEEVIRESENIRITFVENVATLQFAKAEPANAGKYICQIKNDGGMEENMATLMVLEPAVIVEKAGPMTVTVGETCTLECKVAGTPELSVEWYKDGKLLTSSQKHKFSFYNKISSLRILSVERQDAGTYTFQVQNNVGKSSCTAVVDVSDRAVPPSFTRRLKNTGGVLGASCILECKVAGSSPISVAWFHEKTKIVSGAKYQTTFSDNVCTLQLNSLDSSDMGNYTCVAANVAGSDECRAVLTVQEPPSFVKEPEPLEVLPGKNVTFTSVIRGTPPFKVNWFRGARELVKGDRCNIYFEDTVAELELFNIDISQSGEYTCVVSNNAGQASCTTRLFVKEPAAFLKRLSDHSVEPGKSIILESTYTGTLPISVTWKKDGFNITTSEKCNIVTTEKTCILEILNSTKRDAGQYSCEIENEAGRDVCGALVSTLEPPYFVTELEPLEAAVGDSVSLQCQVAGTPEITVSWYKGDTKLRPTPEYRTYFTNNVATLVFNKVNINDSGEYTCKAENSIGTASSKTVFRIQERQLPPSFARQLKDIEQTVGLPVTLTCRLNGSAPIQVCWYRDGVLLRDDENLQTSFVDNVATLKILQTDLSHSGQYSCSASNPLGTASSSARLTAREPKKSPFFDIKPVSIDVIAGESADFECHVTGAQPMRITWSKDNKEIRPGGNYTITCVGNTPHLRILKVGKGDSGQYTCQATNDVGKDMCSAQLSVKEPPKFVKKLEASKVAKQGESIQLECKISGSPEIKVSWFRNDSELHESWKYNMSFINSVALLTINEASAEDSGDYICEAHNGVGDASCSTALTVKAPPVFTQKPSPVGALKGSDVILQCEISGTPPFEVVWVKDRKQVRNSKKFKITSKHFDTSLHILNLEASDVGEYHCKATNEVGSDTCSCSVKFKEPPRFVKKLSDTSTLIGDAVELRAIVEGFQPISVVWLKDRGEVIRESENTRISFIDNIATLQLGSPEASNSGKYICQIKNDAGMRECSAVLTVLEPARIIEKPEPMTVTTGNPFALECVVTGTPELSAKWFKDGRELSADSKHHITFINKVASLKIPCAEMSDKGLYSFEVKNSVGKSNCTVSVHVSDRIVPPSFIRKLKDVNAILGASVVLECRVSGSAPISVGWFQDGNEIVSGPKCQSSFSENVCTLNLSLLEPSDTGIYTCVAANVAGSDECSAVLTVQEPPSFEQTPDSVEVLPGMSLTFTSVIRGTPPFKVKWFKGSRELVPGESCNISLEDFVTELELFEVQPLESGDYSCLVTNDAGSASCTTHLFVKEPATFVKRLADFSVETGSPIVLEATYTGTPPISVSWIKDEYLISQSERCSITMTEKSTILEILESTIEDYAQYSCLIENEAGQDICEALVSVLEPPYFIEPLEHVEAVIGEPATLQCKVDGTPEIRISWYKEHTKLRSAPAYKMQFKNNVASLVINKVDHSDVGEYSCKADNSVGAVASSAVLVIKERKLPPFFARKLKDVHETLGFPVAFECRINGSEPLQVSWYKDGVLLKDDANLQTSFVHNVATLQILQTDQSHIGQYNCSASNPLGTASSSAKLILSEHEVPPFFDLKPVSVDLALGESGTFKCHVTGTAPIKITWAKDNREIRPGGNYKMTLVENTATLTVLKVGKGDAGQYTCYASNIAGKDSCSAHLGVQEPPRFIKKLEPSRIVKQDEFTRYECKIGGSPEIKVLWYKDETEIQESSKFRMSFVDSVAVLEMHNLSVEDSGDYTCEAHNAAGSASSSTSLKVKEPPIFRKKPHPIETLKGADVHLECELQGTPPFHVSWYKDKRELRSGKKYKIMSENFLTSIHILNVDAADIGEYQCKATNDVGSDTCVGSIALKAPPRFVKKLSDISTVVGKEVQLQTTIEGAEPISVVWFKDKGEIVRESDNIWISYSENIATLQFSRVEPANAGKYTCQIKNDAGMQECFATLSVLEPATIVEKPESIKVTTGDTCTLECTVAGTPELSTKWFKDGKELTSDNKYKISFFNKVSGLKIINVAPSDSGVYSFEVQNPVGKDSCTASLQVSDRTVPPSFTRKLKETNGLSGSSVVMECKVYGSPPISVSWFHEGNEISSGRKYQTTLTDNTCALTVNMLEESDSGDYTCIATNMAGSDECSAPLTVREPPSFVQKPDPMDVLTGTNVTFTSIVKGTPPFSVSWFKGSSELVPGDRCNVSLEDSVAELELFDVDTSQSGEYTCIVSNEAGKASCTTHLYIKAPAKFVKRLNDYSIEKGKPLILEGTFTGTPPISVTWKKNGINVTPSQRCNITTTEKSAILEIPSSTVEDAGQYNCYIENASGKDSCSAQILILEPPYFVKQLEPVKVSVGDSASLQCQLAGTPEIGVSWYKGDTKLRPTTTYKMHFRNNVATLVFNQVDINDSGEYICKAENSVGEVSASTFLTVQEQKLPPSFSRQLRDVQETVGLPVVFDCAISGSEPISVSWYKDGKPLKDSPNVQTSFLDNTATLNIFKTDRSLAGQYSCTATNPIGSASSSARLILTEGKNPPFFDIRLAPVDAVVGESADFECHVTGTQPIKVSWAKDSREIRSGGKYQISYLENSAHLTVLKVDKGDSGQYTCYAVNEVGKDSCTAQLNIKERLIPPSFTKRLSETVEETEGNSFKLEGRVAGSQPITVAWYKNNIEIQPTSNCEITFKNNTLVLQVRKAGMNDAGLYTCKVSNDAGSALCTSSIVIKEPKKPPVFDQHLTPVTVSEGEYVQLSCHVQGSEPIRIQWLKAGREIKPSDRCSFSFASGTAVLELRDVAKADSGDYVCKASNVAGSDTTKSKVTIKDKPAVAPATKKAAVDGRLFFVSEPQSIRVVEKTTATFIAKVGGDPIPNVKWTKGKWRQLNQGGRVFIHQKGDEAKLEIRDTTKTDSGLYRCVAFNEHGEIESNVNLQVDERKKQEKIEGDLRAMLKKTPILKKGAGEEEEIDIMELLKNVDPKEYEKYARMYGITDFRGLLQAFELLKQSQEEETHRLEIEEIERSERDEKEFEELVSFIQQRLSQTEPVTLIKDIENQTVLKDNDAVFEIDIKINYPEIKLSWYKGTEKLEPSDKFEISIDGDRHTLRVKNCQLKDQGNYRLVCGPHIASAKLTVIEPAWERHLQDVTLKEGQTCTMTCQFSVPNVKSEWFRNGRILKPQGRHKTEVEHKVHKLTIADVRAEDQGQYTCKYEDLETSAELRIEAEPIQFTKRIQNIVVSEHQSATFECEVSFDDAIVTWYKGPTELTESQKYNFRNDGRCHYMTIHNVTPDDEGVYSVIARLEPRGEARSTAELYLTTKEIKLELKPPDIPDSRVPIPTMPIRAVPPEEIPPVVAPPIPLLLPTPEEKKPPPKRIEVTKKAVKKDAKKVVAKPKEMTPREEIVKKPPPPTTLIPAKAPEIIDVSSKAEEVKIMTITRKKEVQKEKEAVYEKKQAVHKEKRVFIESFEEPYDELEVEPYTEPFEQPYYEEPDEDYEEIKVEAKKEVHEEWEEDFEEGQEYYEREEGYDEGEEEWEEAYQEREVIQVQKEVYEESHERKVPAKVPEKKAPPPPKVIKKPVIEKIEKTSRRMEEEKVQVTKVPEVSKKIVPQKPSRTPVQEEVIEVKVPAVHTKKMVISEEKMFFASHTEEEVSVTVPEVQKEIVTEEKIHVAVSKRVEPPPKVPELPEKPAPEEVAPVPIPKKVEPPAPKVPEVPKKPVPEEKKPVPVPKKEPAAPPKVPEVPKKPVPEEKIPVPVAKKKEAPPAKVPEVQKRVVTEEKITIVTQREESPPPAVPEIPKKKVPEERKPVPRKEEEVPPPPKVPALPKKPVPEEKVAVPVPVAKKAPPPRAEVSKKTVVEEKRFVAEEKLSFAVPQRVEVTRHEVSAEEEWSYSEEEEGVSISVYREEEREEEEEAEVTEYEVMEEPEEYVVEEKLHIISKRVEAEPAEVTERQEKKIVLKPKIPAKIEEPPPAKVPEAPKKIVPEKKVPAPVPKKEKVPPPKVPEEPKKPVPEKKVPPKVIKMEEPLPAKVTERHMQITQEEKVLVAVTKKEAPPKARVPEEPKRAVPEEKVLKLKPKREEEPPAKVTEFRKRVVKEEKVSIEAPKREPQPIKEVTIMEEKERAYTLEEEAVSVQREEEYEEYEEYDYKEFEEYEPTEEYDQYEEYEEREYERYEEHEEYITEPEKPIPVKPVPEEPVPTKPKAPPAKVLKKAVPEEKVPVPIPKKLKPPPPKVPEEPKKVFEEKIRISITKREKEQVTEPAAKVPMKPKRVVAEEKVPVPRKEVAPPVRVPEVPKELEPEEVAFEEEVVTHVEEYLVEEEEEYIHEEEEFITEEEVVPVIPVKVPEVPRKPVPEEKKPVPVPKKKEAPPAKVPEVPKKPEEKVPVLIPKKEKPPPAKVPEVPKKPVPEEKVPVPVPKKVEAPPAKVPEVPKKPVPEKKVPVPAPKKVEAPPAKVPEVPKKLIPEEKKPTPVPKKVEAPPPKVPKKREPVPVPVALPQEEEVLFEEEIVPEEEVLPEEEEVLPEEEEVLPEEEEVLPEEEEIPPEEEEVPPEEEYVPEEEEFVPEEEVLPEVKPKVPVPAPVPEIKKKVTEKKVVIPKKEEAPPAKVPEVPKKVEEKRIILPKEEEVLPVEVTEEPEEEPISEEEIPEEPPSIEEVEEVAPPRVPEVIKKAVPEAPTPVPKKVEAPPAKVSKKIPEEKVPVPVQKKEAPPAKVPEVPKKVPEKKVLVPKKEAVPPAKGRTVLEEKVSVAFRQEVVVKERLELEVVEAEVEEIPEEEEFHEVEEYFEEGEFHEVEEFIKLEQHRVEEEHRVEKVHRVIEVFEAEEVEVFEKPKAPPKGPEISEKIIPPKKPPTKVVPRKEPPAKVPEVPKKIVVEEKVRVPEEPRVPPTKVPDVLPPKEVVPEKKVPVPPAKKPEAPPPKVPEAPKEVVPEKKVPVPPPKKPEVPPTKVPEVPKAAVPEKKVPEAIPPKPESPPPEVPEAPKEVVPEKKVPAAPPKKPEVTPVKVPEAPKEVVPEKKVPVPPPKKPEVPPTKVPEVPKVAVPEKKVPEAIPPKPESPPPEVFEEPEEVALEEPPAEVVEEPEPAAPPQVTVPPKKPVPEKKAPAVVAKKPELPPVKVPEVPKEVVPEKKVPLVVPKKPEAPPAKVPEVPKEVVPEKKVAVPKKPEVPPAKVPEVPKKPVLEEKPAVPVPERAESPPPEVYEEPEEIAPEEEIAPEEEKPVPVAEEEEPEVPPPAVPEEPKKIIPEKKVPVIKKPEAPPPKEPEPEKVIEKPKLKPRPPPPPPAPPKEDVKEKIFQLKAIPKKKVPEKPQVPEKVELTPLKVPGGEKKVRKLLPERKPEPKEEVVLKSVLRKRPEEEEPKVEPKKLEKVKKPAVPEPPPPKPVEEVEVPTVTKRERKIPEPTKVPEIKPAIPLPAPEPKPKPEAEVKTIKPPPVEPEPTPIAAPVTVPVVGKKAEAKAPKEEAAKPKGPIKGVPKKTPSPIEAERRKLRPGSGGEKPPDEAPFTYQLKAVPLKFVKEIKDIILTESEFVGSSAIFECLVSPSTAITTWMKDGSNIRESPKHRFIADGKDRKLHIIDVQLSDAGEYTCVLRLGNKEKTSTAKLVVEELPVRFVKTLEEEVTVVKGQPLYLSCELNKERDVVWRKDGKIVVEKPGRIVPGVIGLMRALTINDADDTDAGTYTVTVENANNLECSSCVKVVEVIRDWLVKPIRDQHVKPKGTAIFACDIAKDTPNIKWFKGYDEIPAEPNDKTEILRDGNHLYLKIKNAMPEDIAEYAVEIEGKRYPAKLTLGEREVELLKPIEDVTIYEKESASFDAEISEADIPGQWKLKGELLRPSPTCEIKAEGGKRFLTLRKVKLDQAGEVLYQALNAITTAILTVKEIELDFAVPLKDVTVPERRQARFECVLTREANVIWSKGPDIIKSSDKFDIIADGKKHILVINDSQFDDEGVYTAEVEGKKTSARLFVTGIRLKFMSPLEDQTVKEGETATFVCELSHEKMHVVWFKNDAKLHTSRTVLISSEGKTHKLEMKEVTLDDISQIKAQVKELSSTAQLKVLEADPYFTVKLHDKTAVEKDEITLKCEVSKDVPVKWFKDGEEIVPSPKYSIKADGLRRILKIKKADLKDKGEYVCDCGTDKTKANVTVEARLIKVEKPLYGVEVFVGETAHFEIELSEPDVHGQWKLKGQPLTASPDCEIIEDGKKHILILHNCQLGMTGEVSFQAANAKSAANLKVKELPLIFITPLSDVKVFEKDEAKFECEVSREPKTFRWLKGTQEITGDDRFELIKDGTKHSMVIKSAAFEDEAKYMFEAEDKHTSGKLIIEGIRLKFLTPLKDVTAKEKESAVFTVELSHDNIRVKWFKNDQRLHTTRSVSMQDEGKTHSITFKDLSIDDTSQIRVEAMGMSSEAKLTVLEGDPYFTGKLQDYTGVEKDEVILQCEISKADAPVKWFKDGKEIKPSKNAVIKADGKKRMLILKKALKSDIGQYTCDCGTDKTSGKLDIEDREIKLVRPLHSVEVMETETARFETEISEDDIHANWKLKGEALLQTPDCEIKEEGKIHSLVLHNCRLDQTGGVDFQAANVKSSAHLRVKPRVIGLLRPLKDVTVTAGETATFDCELSYEDIPVEWYLKGKKLEPSDKVVPRSEGKVHTLTLRDVKLEDAGEVQLTAKDFKTHANLFVKEPPVEFTKPLEDQTVEEGATAVLECEVSRENAKVKWFKNGTEILKSKKYEIVADGRVRKLVIHDCTPEDIKTYTCDAKDFKTSCNLNVVPPHVEFLRPLTDLQVREKEMARFECELSRENAKVKWFKDGAEIKKGKKYDIISKGAVRILVINKCLLDDEAEYSCEVRTARTSGMLTVLEEEAVFTKNLANIEVSETDTIKLVCEVSKPGAEVIWYKGDEEIIETGRYEILTEGRKRILVIQNAHLEDAGNYNCRLPSSRTDGKVKVHELAAEFISKPQNLEILEGEKAEFVCSISKESFPVQWKRDDKTLESGDKYDVIADGKKRVLVVKDATLQDMGTYVVMVGAARAAAHLTVIEKLRIVVPLKDTRVKEQQEVVFNCEVNTEGAKAKWFRNEEAIFDSSKYIILQKDLVYTLRIRDAHLDDQANYNVSLTNHRGENVKSAANLIVEEEDLRIVEPLKDIETMEKKSVTFWCKVNRLNVTLKWTKNGEEVPFDNRVSYRVDKYKHMLTIKDCGFPDEGEYIVTAGQDKSVAELLIIEAPTEFVEHLEDQTVTEFDDAVFSCQLSREKANVKWYRNGREIKEGKKYKFEKDGSIHRLIIKDCRLDDECEYACGVEDRKSRARLFVEEIPVEIIRPPQDILEAPGADVVFLAELNKDKVEVQWLRNNMVVVQGDKHQMMSEGKIHRLQICDIKPRDQGEYRFIAKDKEARAKLELAAAPKIKTADQDLVVDVGKPLTMVVPYDAYPKAEAEWFKENEPLSTKTIDTTAEQTSFRILEAKKGDKGRYKIVLQNKHGKAEGFINLKVIDVPGPVRNLEVTETFDGEVSLAWEEPLTDGGSKIIGYVVERRDIKRKTWVLATDRAESCEFTVTGLQKGGVEYLFRVSARNRVGTGEPVETDNPVEARSKYDVPGPPLNVTITDVNRFGVSLTWEPPEYDGGAEITNYVIELRDKTSIRWDTAMTVRAEDLSATVTDVVEGQEYSFRVRAQNRIGVGKPSAATPFVKVADPIERPSPPVNLTSSDQTQSSVQLKWEPPLKDGGSPILGYIIERCEEGKDNWIRCNMKLVPELTYKVTGLEKGNKYLYRVSAENKAGVSDPSEILGPLTADDAFVEPTMDLSAFKDGLEVIVPNPITILVPSTGYPRPTATWCFGDKVLETGDRVKMKTLSAYAELVISPSERSDKGIYTLKLENRVKTISGEIDVNVIARPSAPKELKFGDITKDSVHLTWEPPDDDGGSPLTGYVVEKREVSRKTWTKVMDFVTDLEFTVPDLVQGKEYLFKVCARNKCGPGEPAYVDEPVNMSTPATVPDPPENVKWRDRTANSIFLTWDPPKNDGGSRIKGYIVERCPRGSDKWVACGEPVAETKMEVTGLEEGKWYAYRVKALNRQGASKPSRPTEEIQAVDTQEAPEIFLDVKLLAGLTVKAGTKIELPATVTGKPEPKITWTKADMILKQDKRITIENVPKKSTVTIVDSKRSDTGTYIIEAVNVCGRATAVVEVNVLDKPGPPAAFDITDVTNESCLLTWNPPRDDGGSKITNYVVERRATDSEVWHKLSSTVKDTNFKATKLIPNKEYIFRVAAENMYGVGEPVQASPITAKYQFDPPGPPTRLEPSDITKDAVTLTWCEPDDDGGSPITGYWVERLDPDTDKWVRCNKMPVKDTTYRVKGLTNKKKYRFRVLAENLAGPGKPSKSTEPILIKDPIDPPWPPGKPTVKDVGKTSVRLNWTKPEHDGGAKIESYVIEMLKTGTDEWVRVAEGVPTTQHLLPGLMEGQEYSFRVRAVNKAGESEPSEPSDPVLCREKLYPPSPPRWLEVINITKNTADLKWTVPEKDGGSPITNYIVEKRDVRRKGWQTVDTTVKDTKCTVTPLTEGSLYVFRVAAENAIGQSDYTEIEDSVLAKDTFTTPGPPYALAVVDVTKRHVDLKWEPPKNDGGRPIQRYVIEKKERLGTRWVKAGKTAGPDCNFRVTDVIEGTEVQFQVRAENEAGVGHPSEPTEILSIEDPTSPPSPPLDLHVTDAGRKHIAIAWKPPEKNGGSPIIGYHVEMCPVGTEKWMRVNSRPIKDLKFKVEEGVVPDKEYVLRVRAVNAIGVSEPSEISENVVAKDPDCKPTIDLETHDIIVIEGEKLSIPVPFRAVPVPTVSWHKDGKEVKASDRLTMKNDHISAHLEVPKSVRADAGIYTITLENKLGSATASINVKVIGLPGPCKDIKASDITKSSCKLTWEPPEFDGGTPILHYVLERREAGRRTYIPVMSGENKLSWTVKDLIPNGEYFFRVKAVNKVGGGEYIELKNPVIAQDPKQPPDPPVDVEVHNPTAEAMTITWKPPLYDGGSKIMGYIIEKIAKGEERWKRCNEHLVPILTYTAKGLEEGKEYQFRVRAENAAGISEPSRATPPTKAVDPIDAPKVILRTSLEVKRGDEIALDASISGSPYPTITWIKDENVIVPEEIKKRAAPLVRRRKGEVQEEEPFVLPLTQRLSIDNSKKGESQLRVRDSLRPDHGLYMIKVENDHGIAKAPCTVSVLDTPGPPINFVFEDIRKTSVLCKWEPPLDDGGSEIINYTLEKKDKTKPDSEWIVVTSTLRHCKYSVTKLIEGKEYLFRVRAENRFGPGPPCVSKPLVAKDPFGPPDAPDKPIVEDVTSNSMLVKWNEPKDNGSPILGYWLEKREVNSTHWSRVNKSLLNALKANVDGLLEGLTYVFRVCAENAAGPGKFSPPSDPKTAHDPISPPGPPIPRVTDTSSTTIELEWEPPAFNGGGEIVGYFVDKQLVGTNEWSRCTEKMIKVRQYTVKEIREGADYKLRVSAVNAAGEGPPGETQPVTVAEPQEPPAVELDVSVKGGIQIMAGKTLRIPAVVTGRPVPTKVWTKEEGELDKDRVVIDNVGTKSELIIKDALRKDHGRYVITATNSCGSKFAAARVEVFDVPGPVLDLKPVVTNRKMCLLNWSDPEDDGGSEITGFIIERKDAKMHTWRQPIETERSKCDITGLLEGQEYKFRVIAKNKFGCGPPVEIGPILAVDPLGPPTSPERLTYTERTKSTITLDWKEPRSNGGSPIQGYIIEKRRHDKPDFERVNKRLCPTTSFLVENLDEHQMYEFRVKAVNEIGESEPSLPLNVVIQDDEVPPTIKLRLSVRGDTIKVKAGEPVHIPADVTGLPMPKIEWSKNETVIEKPTDALQITKEEVSRSEAKTELSIPKAVREDKGTYTVTASNRLGSVFRNVHVEVYDRPSPPRNLAVTDIKAESCYLTWDAPLDNGGSEITHYVIDKRDASRKKAEWEEVTNTAVEKRYGIWKLIPNGQYEFRVRAVNKYGISDECKSDKVVIQDPYRLPGPPGKPKVLARTKGSMLVSWTPPLDNGGSPITGYWLEKREEGSPYWSRVSRAPITKVGLKGVEFNVPRLLEGVKYQFRAMAINAAGIGPPSEPSDPEVAGDPIFPPGPPSCPEVKDKTKSSISLGWKPPAKDGGSPIKGYIVEMQEEGTTDWKRVNEPDKLITTCECVVPNLKELRKYRFRVKAVNEAGESEPSDTTGEIPATDIQEEPEVFIDIGAQDCLVCKAGSQIRIPAVIKGRPTPKSSWEFDGKAKKAMKDGVHDIPEDAQLETAENSSVIIIPECKRSHTGKYSITAKNKAGQKTANCRVKVMDVPGPPKDLKVSDITRGSCRLSWKMPDDDGGDRIKGYVIEKRTIDGKAWTKVNPDCGSTTFVVPDLLSEQQYFFRVRAENRFGIGPPVETIQRTTARDPIYPPDPPIKLKIGLITKNTVHLSWKPPKNDGGSPVTHYIVECLAWDPTGTKKEAWRQCNKRDVEELQFTVEDLVEGGEYEFRVKAVNAAGVSKPSATVGPCDCQRPDMPPSIDLKEFMEVEEGTNVNIVAKIKGVPFPTLTWFKAPPKKPDNKEPVLYDTHVNKLVVDDTCTLVIPQSRRSDTGLYTITAVNNLGTASKEMRLNVLGRPGPPVGPIKFESVSADQMTLSWFPPKDDGGSKITNYVIEKREANRKTWVHVSSEPKECTYTIPKLLEGHEYVFRIMAQNKYGIGEPLDSEPETARNLFSVPGAPDKPTVSSVTRNSMTVNWEEPEYDGGSPVTGYWLEMKDTTSKRWKRVNRDPIKAMTLGVSYKVTGLIEGSDYQFRVYAINAAGVGPASLPSDPATARDPIAPPGPPFPKVTDWTKSSADLEWSPPLKDGGSKVTGYIVEYKEEGKEEWEKGKDKEVRGTKLVVTGLKEGAFYKFRVSAVNIAGIGEPGEVTDVIEMKDRLVSPDLQLDASVRDRIVVHAGGVIRIIAYVSGKPPPTVTWNMNERTLPQEATIETTAISSSMVIKNCQRSHQGVYSLLAKNEAGERKKTIIVDVLDVPGPVGTPFLAHNLTNESCKLTWFSPEDDGGSPITNYVIEKRESDRRAWTPVTYTVTRQNATVQGLIQGKAYFFRIAAENSIGMGPFVETSEALVIREPITVPERPEDLEVKEVTKNTVTLTWNPPKYDGGSEIINYVLESRLIGTEKFHKVTNDNLLSRKYTVKGLKEGDTYEYRVSAVNIVGQGKPSFCTKPITCKDELAPPTLHLDFRDKLTIRVGEAFALTGRYSGKPKPKVSWFKDEADVLEDDRTHIKTTPATLALEKIKAKRSDSGKYCVVVENSTGSRKGFCQVNVVDRPGPPVGPVSFDEVTKDYMVISWKPPLDDGGSKITNYIIEKKEVGKDVWMPVTSASAKTTCKVSKLLEGKDYIFRIHAENLYGISDPLVSDSMKAKDRFRVPDAPDQPIVTEVTKDSALVTWNKPHDGGKPITNYILEKRETMSKRWARVTKDPIHPYTKFRVPDLLEGCQYEFRVSAENEIGIGDPSPPSKPVFAKDPIAKPSPPVNPEAIDTTCNSVDLTWQPPRHDGGSKILGYIVEYQKVGDEEWRRANHTPESCPETKYKVTGLRDGQTYKFRVLAVNAAGESDPAHVPEPVLVKDRLEPPELILDANMAREQHIKVGDTLRLSAIIKGVPFPKVTWKKEDRDAPTKARIDVTPVGSKLEIRNAAHEDGGIYSLTVENPAGSKTVSVKVLVLDKPGPPRDLEVSEIRKDSCYLTWKEPLDDGGSVITNYVVERRDVASAQWSPLSATSKKKSHFAKHLNEGNQYLFRVAAENQYGRGPFVETPKPIKALDPLHPPGPPKDLHHVDVDKTEVSLVWNKPDRDGGSPITGYLVEYQEEGTQDWIKFKTVTNLECVVTGLQQGKTYRFRVKAENIVGLGLPDTTIPIECQEKLVPPSVELDVKLIEGLVVKAGTTVRFPAIIRGVPVPTAKWTTDGSEIKTDEHYTVETDNFSSVLTIKNCLRRDTGEYQITVSNAAGSKTVAVHLTVLDVPGPPTGPINILDVTPEHMTISWQPPKDDGGSPVINYIVEKQDTRKDTWGVVSSGSSKTKLKIPHLQKGCEYVFRVRAENKIGVGPPLDSTPTVAKHKFSPPSPPGKPVVTDITENAATVSWTLPKSDGGSPITGYYMERREVTGKWVRVNKTPIADLKFRVTGLYEGNTYEFRVFAENLAGLSKPSPSSDPIKACRPIKPPGPPINPKLKDKSRETADLVWTKPLSDGGSPILGYVVECQKPGTAQWNRINKDELIRQCAFRVPGLIEGNEYRFRIKAANIVGEGEPRELAESVIAKDILHPPEVELDVTCRDVITVRVGQTIRILARVKGRPEPDITWTKEGKVLVREKRVDLIQDLPRVELQIKEAVRADHGKYIISAKNSSGHAQGSAIVNVLDRPGPCQNLKVTNVTKENCTISWENPLDNGGSEITNFIVEYRKPNQKGWSIVASDVTKRLIKANLLANNEYYFRVCAENKVGVGPTIETKTPILAINPIDRPGEPENLHIADKGKTFVYLKWRRPDYDGGSPNLSYHVERRLKGSDDWERVHKGSIKETHYMVDRCVENQIYEFRVQTKNEGGESDWVKTEEVVVKEDLQKPVLDLKLSGVLTVKAGDTIRLEAGVRGKPFPEVAWTKDKDATDLTRSPRVKIDTRADSSKFSLTKAKRSDGGKYVVTATNTAGSFVAYATVNVLDKPGPVRNLKIVDVSSDRCTVCWDPPEDDGGCEIQNYILEKCETKRMVWSTYSATVLTPGTTVTRLIEGNEYIFRVRAENKIGTGPPTESKPVIAKTKYDKPGRPDPPEVTKVSKEEMTVVWNPPEYDGGKSITGYFLEKKEKHSTRWVPVNKSAIPERRMKVQNLLPDHEYQFRVKAENEIGIGEPSLPSRPVVAKDPIEPPGPPTNFRVVDTTKHSITLGWGKPVYDGGAPIIGYVVEMRPKIADASPDEGWKRCNAAAQLVRKEFTVTSLDENQEYEFRVCAQNQVGIGRPAELKEAIKPKEILEPPEIDLDASMRKLVIVRAGCPIRLFAIVRGRPAPKVTWRKVGIDNVVRKGQVDLVDTMAFLVIPNSTRDDSGKYSLTLVNPAGEKAVFVNVRVLDTPGPVSDLKVSDVTKTSCHVSWAPPENDGGSQVTHYIVEKREADRKTWSTVTPEVKKTSFHVTNLVPGNEYYFRVTAVNEYGPGVPTDVPKPVLASDPLSEPDPPRKLEVTEMTKNSATLAWLPPLRDGGAKIDGYITSYREEEQPADRWTEYSVVKDLSLVVTGLKEGKKYKFRVAARNAVGVSLPREAEGVYEAKEQLLPPKILMPEQITIKAGKKLRIEAHVYGKPHPTCKWKKGEDEVVTSSHLAVHKADSSSILIIKDVTRKDSGYYSLTAENSSGTDTQKIKVVVMDAPGPPQPPFDISDIDADACSLSWHIPLEDGGSNITNYIVEKCDVSRGDWVTALASVTKTSCRVGKLIPGQEYIFRVRAENRFGISEPLTSPKMVAQFPFGVPSEPKNARVTKVNKDCIFVAWDRPDSDGGSPIIGYLIERKERNSLLWVKANDTLVRSTEYPCAGLVEGLEYSFRIYALNKAGSSPPSKPTEYVTARMPVDPPGKPEVIDVTKSTVSLIWARPKHDGGSKIIGYFVEACKLPGDKWVRCNTAPHQIPQEEYTATGLEEKAQYQFRAIARTAVNISPPSEPSDPVTILAENVPPRIDLSVAMKSLLTVKAGTNVCLDATVFGKPMPTVSWKKDGTLLKPAEGIKMAMQRNLCTLELFSVNRKDSGDYTITAENSSGSKSATIKLKVLDKPGPPASVKINKMYSDRAMLSWEPPLEDGGSEITNYIVDKRETSRPNWAQVSATVPITSCSVEKLIEGHEYQFRICAENKYGVGDPVFTEPAIAKNPYDPPGRCDPPVISNITKDHMTVSWKPPADDGGSPITGYLLEKRETQAVNWTKVNRKPIIERTLKATGLQEGTEYEFRVTAINKAGPGKPSDASKAAYARDPQYPPAPPAFPKVYDTTRSSVSLSWGKPAYDGGSPIIGYLVEVKRADSDNWVRCNLPQNLQKTRFEVTGLMEDTQYQFRVYAVNKIGYSDPSDVPDKHYPKDILIPPEGELDADLRKTLILRAGVTMRLYVPVKGRPPPKITWSKPNVNLRDRIGLDIKSTDFDTFLRCENVNKYDAGKYILTLENSCGKKEYTIVVKVLDTPGPPVNVTVKEISKDSAYVTWEPPIIDGGSPIINYVVQKRDAERKSWSTVTTECSKTSFRVANLEEGKSYFFRVFAENEYGIGDPGETRDAVKASQTPGPVVDLKVRSVSKSSCSIGWKKPHSDGGSRIIGYVVDFLTEENKWQRVMKSLSLQYSAKDLTEGKEYTFRVSAENENGEGTPSEITVVARDDVVAPDLDLKGLPDLCYLAKENSNFRLKIPIKGKPAPSVSWKKGEDPLATDTRVSVESSAVNTTLIVYDCQKSDAGKYTITLKNVAGTKEGTISIKVVGKPGIPTGPIKFDEVTAEAMTLKWAPPKDDGGSEITNYILEKRDSVNNKWVTCASAVQKTTFRVTRLHEGMEYTFRVSAENKYGVGEGLKSEPIVARHPFDVPDAPPPPNIVDVRHDSVSLTWTDPKKTGGSPITGYHLEFKERNSLLWKRANKTPIRMRDFKVTGLTEGLEYEFRVMAINLAGVGKPSLPSEPVVALDPIDPPGKPEVINITRNSVTLIWTEPKYDGGHKLTGYIVEKRDLPSKSWMKANHVNVPECAFTVTDLVEGGKYEFRIRAKNTAGAISAPSESTETIICKDEYEAPTIVLDPTIKDGLTIKAGDTIVLNAISILGKPLPKSSWSKAGKDIRPSDITQITSTPTSSMLTIKYATRKDAGEYTITATNPFGTKVEHVKVTVLDVPGPPGPVEISNVSAEKATLTWTPPLEDGGSPIKSYILEKRETSRLLWTVVSEDIQSCRHVATKLIQGNEYIFRVSAVNHYGKGEPVQSEPVKMVDRFGPPGPPEKPEVSNVTKNTATVSWKRPVDDGGSEITGYHVERREKKSLRWVRAIKTPVSDLRCKVTGLQEGSTYEFRVSAENRAGIGPPSEASDSVLMKDAAYPPGPPSNPHVTDTTKKSASLAWGKPHYDGGLEITGYVVEHQKVGDEAWIKDTTGTALRITQFVVPDLQTKEKYNFRISAINDAGVGEPAVIPDVEIVEREMAPDFELDAELRRTLVVRAGLSIRIFVPIKGRPAPEVTWTKDNINLKNRANIENTESFTLLIIPECNRYDTGKFVMTIENPAGKKSGFVNVRVLDTPGPVLNLRPTDITKDSVTLHWDLPLIDGGSRITNYIVEKREATRKSYSTATTKCHKCTYKVTGLSEGCEYFFRVMAENEYGIGEPTETTEPVKASEAPSPPDSLNIMDITKSTVSLAWPKPKHDGGSKITGYVIEAQRKGSDQWTHITTVKGLECVVRNLTEGEEYTFQVMAVNSAGRSAPRESRPVIVKEQTMLPELDLRGIYQKLVIAKAGDNIKVEIPVLGRPKPTVTWKKGDQILKQTQRVNFETTATSTILNINECVRSDSGPYPLTARNIVGEVGDVITIQVHDIPGPPTGPIKFDEVSSDFVTFSWDPPENDGGVPISNYVVEMRQTDSTTWVELATTVIRTTYKATRLTTGLEYQFRVKAQNRYGVGPGITSACIVANYPFKVPGPPGTPQVTAVTKDSMTISWHEPLSDGGSPILGYHVERKERNGILWQTVSKALVPGNIFKSSGLTDGIAYEFRVIAENMAGKSKPSKPSEPMLALDPIDPPGKPVPLNITRHTVTLKWAKPEYTGGFKITSYIVEKRDLPNGRWLKANFSNILENEFTVSGLTEDAAYEFRVIAKNAAGAISPPSEPSDAITCRDDVEAPKIKVDVKFKDTVILKAGEAFRLEADVSGRPPPTMEWSKDGKELEGTAKLEIKIADFSTNLVNKDSTRRDSGAYTLTATNPGGFAKHIFNVKVLDRPGPPEGPLAVTEVTSEKCVLSWFPPLDDGGAKIDHYIVQKRETSRLAWTNVASEVQVTKLKVTKLLKGNEYIFRVMAVNKYGVGEPLESEPVLAVNPYGPPDPPKNPEVTTITKDSMVVCWGHPDSDGGSEIINYIVERRDKAGQRWIKCNKKTLTDLRYKVSGLTEGHEYEFRIMAENAAGISAPSPTSPFYKACDTVFKPGPPGNPRVLDTSRSSISIAWNKPIYDGGSEITGYMVEIALPEEDEWQIVTPPAGLKATSYTITGLTENQEYKIRIYAMNSEGLGEPALVPGTPKAEDRMLPPEIELDADLRKVVTIRACCTLRLFVPIKGRPAPEVKWARDHGESLDKASIESTSSYTLLIVGNVNRFDSGKYILTVENSSGSKSAFVNVRVLDTPGPPQDLKVKEVTKTSVTLTWDPPLLDGGSKIKNYIVEKRESTRKAYSTVATNCHKTSWKVDQLQEGCSYYFRVLAENEYGIGLPAETAESVKASERPLPPGKITLMDVTRNSVSLSWEKPEHDGGSRILGYIVEMQTKGSDKWATCATVKVTEATITGLIQGEEYSFRVSAQNEKGISDPRQLSVPVIAKDLVIPPAFKLLFNTFTVLAGEDLKVDVPFIGRPTPAVTWHKDNVPLKQTTRVNAESTENNSLLTIKDACREDVGHYVVKLTNSAGEAIETLNVIVLDKPGPPTGPVKMDEVTADSITLSWGPPKYDGGSSINNYIVEKRDTSTTTWQIVSATVARTTIKACRLKTGCEYQFRIAAENRYGKSTYLNSEPTVAQYPFKVPGPPGTPVVTLSSRDSMEVQWNEPISDGGSRVIGYHLERKERNSILWVKLNKTPIPQTKFKTTGLEEGVEYEFRVSAENIVGIGKPSKVSECYVARDPCDPPGRPEAIIVTRNSVTLQWKKPTYDGGSKITGYIVEKKELPEGRWMKASFTNIIDTHFEVTGLVEDHRYEFRVIARNAAGVFSEPSESTGAITARDEVDPPRISMDPKYKDTIVVHAGESFKVDADIYGKPIPTIQWIKGDQELSNTARLEIKSTDFATSLSVKDAVRVDSGNYILKAKNVAGERSVTVNVKVLDRPGPPEGPVVISGVTAEKCTLAWKPPLQDGGSDIINYIVERRETSRLVWTVVDANVQTLSCKVTKLLEGNEYTFRIMAVNKYGVGEPLESEPVVAKNPFVVPDAPKAPEVTTVTKDSMIVVWERPASDGGSEILGYVLEKRDKEGIRWTRCHKRLIGELRLRVTGLIENHDYEFRVSAENAAGLSEPSPPSAYQKACDPIYKPGPPNNPKVIDITRSSVFLSWSKPIYDGGCEIQGYIVEKCDVSVGEWTMCTPPTGINKTNIEVEKLLEKHEYNFRICAINKAGVGEHADVPGPIIVEEKLEAPDIDLDLELRKIINIRAGGSLRLFVPIKGRPTPEVKWGKVDGEIRDAAIIDVTSSFTSLVLDNVNRYDSGKYTLTLENSSGTKSAFVTVRVLDTPSPPVNLKVTEITKDSVSITWEPPLLDGGSKIKNYIVEKREATRKSYAAVVTNCHKNSWKIDQLQEGCSYYFRVTAENEYGIGLPAQTADPIKVAEVPQPPGKITVDDVTRNSVSLSWTKPEHDGGSKIIQYIVEMQAKHSEKWSECARVKSLQAVITNLTQGEEYLFRVVAVNEKGRSDPRSLAVPIVAKDLVIEPDVKPAFSSYSVQVGQDLKIEVPISGRPKPTITWTKDGLPLKQTTRINVTDSLDLTTLSIKETHKDDGGQYGITVANVVGQKTASIEIVTLDKPDPPKGPVKFDDVSAESITLSWNPPLYTGGCQITNYIVQKRDTTTTVWDVVSATVARTTLKVTKLKTGTEYQFRIFAENRYGQSFALESDPIVAQYPYKEPGPPGTPFATAISKDSMVIQWHEPVNNGGSPVIGYHLERKERNSILWTKVNKTIIHDTQFKAQNLEEGIEYEFRVYAENIVGVGKASKNSECYVARDPCDPPGTPEPIMVKRNEITLQWTKPVYDGGSMITGYIVEKRDLPDGRWMKASFTNVIETQFTVSGLTEDQRYEFRVIAKNAAGAISKPSDSTGPITAKDEVELPRISMDPKFRDTIVVNAGETFRLEADVHGKPLPTIEWLRGDKEIEESARCEIKNTDFKALLIVKDAIRIDGGQYILRASNVAGSKSFPVNVKVLDRPGPPEGPVQVTGVTSEKCSLTWSPPLQDGGSDISHYVVEKRETSRLAWTVVASEVVTNSLKVTKLLEGNEYVFRIMAVNKYGVGEPLESAPVLMKNPFVLPGPPKSLEVTNIAKDSMTVCWNRPDSDGGSEIIGYIVEKRDRSGIRWIKCNKRRITDLRLRVTGLTEDHEYEFRVSAENAAGVGEPSPATVYYKACDPVFKPGPPTNAHIVDTTKNSITLAWGKPIYDGGSEILGYVVEICKADEEEWQIVTPQTGLRVTRFEISKLTEHQEYKIRVCALNKVGLGEATSVPGTVKPEDKLEAPELDLDSELRKGIVVRAGGSARIHIPFKGRPTPEITWSREEGEFTDKVQIEKGVNYTQLSIDNCDRNDAGKYILKLENSSGSKSAFVTVKVLDTPGPPQNLAVKEVRKDSAFLVWEPPIIDGGAKVKNYVIDKRESTRKAYANVSSKCSKTSFKVENLTEGAIYYFRVMAENEFGVGVPVETVDAVKAAEPPSPPGKVTLTDVSQTSASLMWEKPEHDGGSRVLGYVVEMQPKGTEKWSIVAESKVCNAVVTGLSSGQEYQFRVKAYNEKGKSDPRVLGVPVIAKDLTIQPSLKLPFNTYSIQAGEDLKIEIPVIGRPRPNISWVKDGEPLKQTTRVNVEETATSTVLHIKEGNKDDFGKYTVTATNSAGTATENLSVIVLEKPGPPVGPVRFDEVSADFVVISWEPPAYTGGCQISNYIVEKRDTTTTTWHMVSATVARTTIKITKLKTGTEYQFRIFAENRYGKSAPLDSKAVIVQYPFKEPGPPGTPFVTSISKDQMLVQWHEPVNDGGTKIIGYHLEQKEKNSILWVKLNKTPIQDTKFKTTGLDEGLEYEFKVSAENIVGIGKPSKVSECFVARDPCDPPGRPEAIVITRNNVTLKWKKPAYDGGSKITGYIVEKKDLPDGRWMKASFTNVLETEFTVSGLVEDQRYEFRVIARNAAGNFSEPSDSSGAITARDEIDAPNASLDPKYKDVIVVHAGETFVLEADIRGKPIPDVVWSKDGKELEETAARMEIKSTIQKTTLVVKDCIRTDGGQYILKLSNVGGTKSIPITVKVLDRPGPPEGPLKVTGVTAEKCYLAWNPPLQDGGANISHYIIEKRETSRLSWTQVSTEVQALNYKVTKLLPGNEYIFRVMAVNKYGIGEPLESGPVTACNPYKPPGPPSTPEVSAITKDSMVVTWARPVDDGGTEIEGYILEKRDKEGVRWTKCNKKTLTDLRLRVTGLTEGHSYEFRVAAENAAGVGEPSEPSVFYRACDALYPPGPPSNPKVTDTSRSSVSLAWSKPIYDGGAPVKGYVVEVKEAAADEWTTCTPPTGLQGKQFTVTKLKENTEYNFRICAINSEGVGEPATLPGSVVAQERIEPPEIELDADLRKVVVLRASATLRLFVTIKGRPEPEVKWEKAEGILTDRAQIEVTSSFTMLVIDNVTRFDSGRYNLTLENNSGSKTAFVNVRVLDSPSAPVNLTIREVKKDSVTLSWEPPLIDGGAKITNYIVEKRETTRKAYATITNNCTKTTFRIENLQEGCSYYFRVLASNEYGIGLPAETTEPVKVSEPPLPPGRVTLVDVTRNTATIKWEKPESDGGSKITGYVVEMQTKGSEKWSTCTQVKTLEATISGLTAGEEYVFRVAAVNEKGRSDPRQLGVPVIARDIEIKPSVELPFHTFNVKAREQLKIDVPFKGRPQATVNWRKDGQTLKETTRVNVSSSKTVTSLSIKEASKEDVGTYELCVSNSAGSITVPITIIVLDRPGPPGPIRIDEVSCDSITISWNPPEYDGGCQISNYIVEKKETTSTTWHIVSQAVARTSIKIVRLTTGSEYQFRVCAENRYGKSSYSESSAVVAEYPFSPPGPPGTPKVVHATKSTMLVTWQVPVNDGGSRVIGYHLEYKERSSILWSKANKILIADTQMKVSGLDEGLMYEYRVYAENIAGIGKCSKSCEPVPARDPCDPPGQPEVTNITRKSVSLKWSKPHYDGGAKITGYIVERRELPDGRWLKCNYTNIQETYFEVTELTEDQRYEFRVFARNAADSVSEPSESTGPIIVKDDVEPPRVMMDVKFRDVIVVKAGEVLKINADIAGRPLPVISWAKDGIEIEERARTEIISTDNHTLLTVKDCIRRDTGQYVLTLKNVAGTRSVAVNCKVLDKPGPPAGPLEINGLTAEKCSLSWGRPQEDGGADIDYYIVEKRETSHLAWTICEGELQMTSCKVTKLLKGNEYIFRVTGVNKYGVGEPLESVAIKALDPFTVPSPPTSLEITSVTKESMTLCWSRPESDGGSEISGYIIERREKNSLRWVRVNKKPVYDLRVKSTGLREGCEYEYRVYAENAAGLSLPSETSPLIRAEDPVFLPSPPSKPKIVDSGKTTITIAWVKPLFDGGAPITGYTVEYKKSDDTDWKTSIQSLRGTEYTISGLTTGAEYVFRVKSVNKVGASDPSDSSDPQIAKEREEEPLFDIDSEMRKTLIVKAGASFTMTVPFRGRPVPNVLWSKPDTDLRTRAYVDTTDSRTSLTIENANRNDSGKYTLTIQNVLSAASLTLVVKVLDTPGPPTNITVQDVTKESAVLSWDVPENDGGAPVKNYHIEKREASKKAWVSVTNNCNRLSYKVTNLQEGAIYYFRVSGENEFGVGIPAETKEGVKITEKPSPPEKLGVTSISKDSVSLTWLKPEHDGGSRIVHYVVEALEKGQKNWVKCAVAKSTHHVVSGLRENSEYFFRVFAENQAGLSDPRELLLPVLIKEQLEPPEIDMKNFPSHTVYVRAGSNLKVDIPISGKPLPKVTLSRDGVPLKATMRFNTEITAENLTINLKESVTADAGRYEITAANSSGTTKAFINIVVLDRPGPPTGPVVISDITEESVTLKWEPPKYDGGSQVTNYILLKRETSTAVWTEVSATVARTMMKVMKLTTGEEYQFRIKAENRFGISDHIDSACVTVKLPYTTPGPPSTPWVTNVTRESITVGWHEPVSNGGSAVVGYHLEMKDRNSILWQKANKLVIRTTHFKVTTISAGLIYEFRVYAENAAGVGKPSHPSEPVLAIDACEPPRNVRITDISKNSVSLSWQQPAFDGGSKITGYIVERRDLPDGRWTKASFTNVTETQFIISGLTQNSQYEFRVFARNAVGSISNPSEVVGPITCIDSYGGPVIDLPLEYTEVVKYRAGTSVKLRAGISGKPAPTIEWYKDDKELQTNALVCVENTTDLASILIKDADRLNSGCYELKLRNAMGSASATIRVQILDKPGPPGGPIEFKTVTAEKITLLWRPPADDGGAKITHYIVEKRETSRVVWSMVSEHLEECIITTTKIIKGNEYIFRVRAVNKYGIGEPLESDSVVAKNAFVTPGPPGIPEVTKITKNSMTVVWSRPIADGGSDISGYFLEKRDKKSLGWFKVLKETIRDTRQKVTGLTENSDYQYRVCAVNAAGQGPFSEPSEFYKAADPIDPPGPPAKIRIADSTKSSITLGWSKPVYDGGSAVTGYVVEIRQGEEEEWTTVSTKGEVRTTEYVVSNLKPGVNYYFRVSAVNCAGQGEPIEMNEPVQAKDILEAPEIDLDVALRTSVIAKAGEDVQVLIPFKGRPPPTVTWRKDEKNLGSDARYSIENTDSSSLLTIPQVTRNDTGKYILTIENGVGEPKSSTVSVKVLDTPAACQKLQVKHVSRGTVTLLWDPPLIDGGSPIINYVIEKRDATKRTWSVVSHKCSSTSFKLIDLSEKTPFFFRVLAENEIGIGEPCETTEPVKAAEVPAPIRDLSMKDSTKTSVILSWTKPDFDGGSVITEYVVERKGKGEQTWSHAGISKTCEIEVSQLKEQSVLEFRVFAKNEKGLSDPVTIGPITVKELIITPEVDLSDIPGAQVTVRIGHNVHLELPYKGKPKPSISWLKDGLPLKESEFVRFSKTENKITLSIKNAKKEHGGKYTVILDNAVCRIAVPITVITLGPPSKPKGPIRFDEIKADSVILSWDVPEDNGGGEITCYSIEKRETSQTNWKMVCSSVARTTFKVPNLVKDAEYQFRVRAENRYGVSQPLVSSIIVAKHQFRIPGPPGKPVIYNVTSDGMSLTWDAPVYDGGSEVTGFHVEKKERNSILWQKVNTSPISGREYRATGLVEGLDYQFRVYAENSAGLSSPSDPSKFTLAVSPVDPPGTPDYIDVTRETITLKWNPPLRDGGSKIVGYSIEKRQGNERWVRCNFTDVSECQYTVTGLSPGDRYEFRIIARNAVGTISPPSQSSGIIMTRDENVPPIVEFGPEYFDGLIIKSGESLRIKALVQGRPVPRVTWFKDGVEIEKRMNMEITDVLGSTSLFVRDATRDHRGVYTVEAKNASGSAKAEIKVKVQDTPGKVVGPIRFTNITGEKMTLWWDAPLNDGCAPITHYIIEKRETSRLAWALIEDKCEAQSYTAIKLINGNEYQFRVSAVNKFGVGRPLDSDPVVAQIQYTVPDAPGIPEPSNITGNSITLTWARPESDGGSEIQQYILERREKKSTRWVKVISKRPISETRFKVTGLTEGNEYEFHVMAENAAGVGPASGISRLIKCREPVNPPGPPTVVKVTDTSKTTVSLEWSKPVFDGGMEIIGYIIEMCKADLGDWHKVNAEACVKTRYTVTDLQAGEEYKFRVSAINGAGKGDSCEVTGTIKAVDRLTAPELDIDANFKQTHVVRAGASIRLFIAYQGRPTPTAVWSKPDSNLSLRADIHTTDSFSTLTVENCNRNDAGKYTLTVENNSGSKSITFTVKVLDTPGPPGPITFKDVTRGSATLMWDAPLLDGGARIHHYVVEKREASRRSWQVISEKCTRQIFKVNDLAEGVPYYFRVSAVNEYGVGEPYEMPEPIVATEQPAPPRRLDVVDTSKSSAVLAWLKPDHDGGSRITGYLLEMRQKGSDFWVEAGHTKQLTFTVERLVEKTEYEFRVKAKNDAGYSEPREAFSSVIIKEPQIEPTADLTGITNQLITCKAGSPFTIDVPISGRPAPKVTWKLEEMRLKETDRVSITTTKDRTTLTVKDSMRGDSGRYFLTLENTAGVKTFSVTVVVIGRPGPVTGPIEVSSVSAESCVLSWGEPKDGGGTEITNYIVEKRESGTTAWQLVNSSVKRTQIKVTHLTKYMEYSFRVSSENRFGVSKPLESAPIIAEHPFVPPSAPTRPEVYHVSANAMSIRWEEPYHDGGSKIIGYWVEKKERNTILWVKENKVPCLECNYKVTGLVEGLEYQFRTYALNAAGVSKASEASRPIMAQNPVDAPGRPEVTDVTRSTVSLIWSAPAYDGGSKVVGYIIERKPVSEVGDGRWLKCNYTIVSDNFFTVTALSEGDTYEFRVLAKNAAGVISKGSESTGPVTCRDEYAPPKAELDARLHGDLVTIRAGSDLVLDAAVGGKPEPKIIWTKGDKELDLCEKVSLQYTGKRATAVIKFCDRSDSGKYTLTVKNASGTKAVSVMVKVLDSPGPCGKLTVSRVTQEKCTLAWSLPQEDGGAEITHYIVERRETSRLNWVIVEGECPTLSYVVTRLIKNNEYIFRVRAVNKYGPGVPVESEPIVARNSFTIPSPPGIPEEVGTGKEHIIIQWTKPESDGGNEISNYLVDKREKKSLRWTRVNKDYVVYDTRLKVTSLMEGCDYQFRVTAVNAAGNSEPSEASNFISCREPSYTPGPPSAPRVVDTTKHSISLAWTKPMYDGGTDIVGYVLEMQEKDTDQWYRVHTNATIRNTEFTVPDLKMGQKYSFRVAAVNVKGMSEYSESIAEIEPVERIEIPDLELADDLKKTVTIRAGASLRLMVSVSGRPPPVITWSKQGIDLASRAIIDTTESYSLLIVDKVNRYDAGKYTIEAENQSGKKSATVLVKVYDTPGPCPSVKVKEVSRDSVTITWEIPTIDGGAPVNNYIVEKREAAMRAFKTVTTKCSKTLYRISGLVEGTMYYFRVLPENIYGIGEPCETSDAVLVSEVPLVPAKLEVVDVTKSTVTLAWEKPLYDGGSRLTGYVLEACKAGTERWMKVVTLKPTVLEHTVTSLNEGEQYLFRIRAQNEKGVSEPRETVTAVTVQDLRVLPTIDLSTMPQKTIHVPAGRPVELVIPIAGRPPPAASWFFAGSKLRESERVTVETHTKVAKLTIRETTIRDTGEYTLELKNVTGTTSETIKVIILDKPGPPTGPIKIDEIDATSITISWEPPELDGGAPLSGYVVEQRDAHRPGWLPVSESVTRSTFKFTRLTEGNEYVFRVAATNRFGIGSYLQSEVIECRSSIRIPGPPETLQIFDVSRDGMTLTWYPPEDDGGSQVTGYIVERKEVRADRWVRVNKVPVTMTRYRSTGLTEGLEYEHRVTAINARGSGKPSRPSKPIVAMDPIAPPGKPQNPRVTDTTRTSVSLAWSVPEDEGGSKVTGYLIEMQKVDQHEWTKCNTTPTKIREYTLTHLPQGAEYRFRVLACNAGGPGEPAEVPGTVKVTEMLEYPDYELDERYQEGIFVRQGGVIRLTIPIKGKPFPICKWTKEGQDISKRAMIATSETHTELVIKEADRGDSGTYDLVLENKCGKKAVYIKVRVIGSPNSPEGPLEYDDIQVRSVRVSWRPPADDGGADILGYILERREVPKAAWYTIDSRVRGTSLVVKGLKENVEYHFRVSAENQFGISKPLKSEEPVTPKTPLNPPEPPSNPPEVLDVTKSSVSLSWSRPKDDGGSRVTGYYIERKETSTDKWVRHNKTQITTTMYTVTGLVPDAEYQFRIIAQNDVGLSETSPASEPVVCKDPFDKPSQPGELEILSISKDSVTLQWEKPECDGGKEILGYWVEYRQSGDSAWKKSNKERIKDKQFTIGGLLEATEYEFRVFAENETGLSRPRRTAMSIKTKLTSGEAPGIRKEMKDVTTKLGEAAQLSCQIVGRPLPDIKWYRFGKELIQSRKYKMSSDGRTHTLTVMTEEQEDEGVYTCIATNEVGEVETSSKLLLQATPQFHPGYPLKEKYYGAVGSTLRLHVMYIGRPVPAMTWFHGQKLLQNSENITIENTEHYTHLVMKNVQRKTHAGKYKVQLSNVFGTVDAILDVEIQDKPDKPTGPIVIEALLKNSAVISWKPPADDGGSWITNYVVEKCEAKEGAEWQLVSSAISVTTCRIVNLTENAGYYFRVSAQNTFGISDPLEVSSVVIIKSPFEKPGAPGKPTITAVTKDSCVVAWKPPASDGGAKIRNYYLEKREKKQNKWISVTTEEIRETVFSVKNLIEGLEYEFRVKCENLGGESEWSEISEPITPKSDVPIQAPHFKEELRNLNVRYQSNATLVCKVTGHPKPIVKWYRQGKEIIADGLKYRIQEFKGGYHQLIIASVTDDDATVYQVRATNQGGSVSGTASLEVEVPAKIHLPKTLEGMGAVHALRGEVVSIKIPFSGKPDPVITWQKGQDLIDNNGHYQVIVTRSFTSLVFPNGVERKDAGFYVVCAKNRFGIDQKTVELDVADVPDPPRGVKVSDVSRDSVNLTWTEPASDGGSKITNYIVEKCATTAERWLRVGQARETRYTVINLFGKTSYQFRVIAENKFGLSKPSEPSEPTITKEDKTRAMNYDEEVDETREVSMTKASHSSTKELYEKYMIAEDLGRGEFGIVHRCVETSSKKTYMAKFVKVKGTDQVLVKKEISILNIARHRNILHLHESFESMEELVMIFEFISGLDIFERINTSAFELNEREIVSYVHQVCEALQFLHSHNIGHFDIRPENIIYQTRRSSTIKIIEFGQARQLKPGDNFRLLFTAPEYYAPEVHQHDVVSTATDMWSLGTLVYVLLSGINPFLAETNQQIIENIMNAEYTFDEEAFKEISIEAMDFVDRLLVKERKSRMTASEALQHPWLKQKIERVSTKVIRTLKHRRYYHTLIKKDLNMVVSAARISCGGAIRSQKGVSVAKVKVASIEIGPVSGQIMHAVGEEGGHVKYVCKIENYDQSTQVTWYFGVRQLENSEKYEITYEDGVAILYVKDITKLDDGTYRCKVVNDYGEDSSYAELFVKGVREVYDYYCRRTMKKIKRRTDTMRLLERPPEFTLPLYNKTAYVGENVRFGVTITVHPEPHVTWYKSGQKIKPGDNDKKYTFESDKGLYQLTINSVTTDDDAEYTVVARNKYGEDSCKAKLTVTLHPPPTDSTLRPMFKRLLANAECQEGQSVCFEIRVSGIPPPTLKWEKDGQPLSLGPNIEIIHEGLDYYALHIRDTLPEDTGYYRVTATNTAGSTSCQAHLQVERLRYKKQEFKSKEEHERHVQKQIDKTLRMAEILSGTESVPLTQVAKEALREAAVLYKPAVSTKTVKGEFRLEIEEKKEERKLRMPYDVPEPRKYKQTTIEEDQRIKQFVPMSDMKWYKKIRDQYEMPGKLDRVVQKRPKRIRLSRWEQFYVMPLPRITDQYRPKWRIPKLSQDDLEIVRPARRRTPSPDYDFYYRPRRRSLGDISDEELLLPIDDYLAMKRTEEERLRLEEELELGFSASPPSRSPPHFELSSLRYSSPQAHVKVEETRKDFRYSTYHIPTKAEASTSYAELRERHAQAAYRQPKQRQRIMAEREDEELLRPVTTTQHLSEYKSELDFMSKEEKSRKKSRRQREVTEITEIEEEYEISKHAQRESSSSASRLLRRRRSLSPTYIELMRPVSELIRSRPQPAEEYEDDTERRSPTPERTRPRSPSPVSSERSLSRFERSARFDIFSRYESMKAALKTQKTSERKYEVLSQQPFTLDHAPRITLRMRSHRVPCGQNTRFILNVQSKPTAEVKWYHNGVELQESSKIHYTNTSGVLTLEILDCHTDDSGTYRAVCTNYKGEASDYATLDVTGGDYTTYASQRRDEEVPRSVFPELTRTEAYAVSSFKKTSEMEASSSVREVKSQMTETRESLSSYEHSASAEMKSAALEEKSLEEKSTTRKIKTTLAARILTKPRSMTVYEGESARFSCDTDGEPVPTVTWLRKGQVLSTSARHQVTTTKYKSTFEISSVQASDEGNYSVVVENSEGKQEAEFTLTIQKARVTEKAVTSPPRVKSPEPRVKSPEAVKSPKRVKSPEPSHPKAVSPTETKPTPTEKVQHLPVSAPPKITQFLKAEASKEIAKLTCVVESSVLRAKEVTWYKDGKKLKENGHFQFHYSADGTYELKINNLTESDQGEYVCEISGEGGTSKTNLQFMGQAFKSIHEKVSKISETKKSDQKTTESTVTRKTEPKAPEPISSKPVIVTGLQDTTVSSDSVAKFAVKATGEPRPTAIWTKDGKAITQGGKYKLSEDKGGFFLEIHKTDTSDSGLYTCTVKNSAGSVSSSCKLTIKAIKDTEAQKVSTQKTSEITPQKKAVVQEEISQKALRSEEIKMSEAKSQEKLALKEEASKVLISEEVKKSAATSLEKSIVHEEITKTSQASEEVRTHAEIKAFSTQMSINEGQRLVLKANIAGATDVKWVLNGVELTNSEEYRYGVSGSDQTLTIKQASHRDEGILTCISKTKEGIVKCQYDLTLSKELSDAPAFISQPRSQNINEGQNVLFTCEISGEPSPEIEWFKNNLPISISSNVSISRSRNVYSLEIRNASVSDSGKYTIKAKNFRGQCSATASLMVLPLVEEPSREVVLRTSGDTSLQGSFSSQSVQMSASKQEASFSSFSSSSASSMTEMKFASMSAQSMSSMQESFVEMSSSSFMGISNMTQLESSTSKMLKAGIRGIPPKIEALPSDISIDEGKVLTVACAFTGEPTPEVTWSCGGRKIHSQEQGRFHIENTDDLTTLIIMDVQKQDGGLYTLSLGNEFGSDSATVNIHIRSI

SEQ ID NO: 3 - DNA, 36 bp, Artificial Sequence
  Description of Artificial Sequence: Synthetic primer
ccatcatgttctggttttgtccaattcaaccttact

SEQ ID NO: 4 - DNA, 26 bp, Artificial Sequence
  Description of Artificial Sequence: Synthetic primer
tttgaacttgagttgccttatctatc

SEQ ID NO: 5 - DNA, 22 bp, Artificial Sequence
  Description of Artificial Sequence: Synthetic primer
acctcaggcgttccacttgtag

SEQ ID NO: 6 - DNA, 22 bp, Artificial Sequence
  Description of Artificial Sequence: Synthetic primer
tgtattttccagcatcgtaccg

SEQ ID NO: 7 - DNA, 25 bp, Artificial Sequence
  Description of Artificial Sequence: Synthetic primer
ggttcaccaactccattttctattg

SEQ ID NO: 8 - DNA, 22 bp, Artificial Sequence
  Description of Artificial Sequence: Synthetic primer
caagcatggtagattttgtggc

SEQ ID NO: 9 - DNA, 20 bp, Artificial Sequence
  Description of Artificial Sequence: Synthetic primer
ggaaatggctgtggcaaatg

SEQ ID NO: 10 - DNA, 23 bp, Artificial Sequence
  Description of Artificial Sequence: Synthetic primer
gccagctaattgtcattgaatcc

SEQ ID NO: 11 - DNA, 22 bp, Artificial Sequence
  Description of Artificial Sequence: Synthetic primer
tccgagatttaaatgtgcctcc

SEQ ID NO: 12 - DNA, 21 bp, Artificial Sequence
  Description of Artificial Sequence: Synthetic primer
tggccgttacactttgctctg

SEQ ID NO: 13 - DNA, 22 bp, Artificial Sequence
  Description of Artificial Sequence: Synthetic primer
ttactccaaaccggacattttc

SEQ ID NO: 14 - DNA, 26 bp, Artificial Sequence
  Description of Artificial Sequence: Synthetic primer
gattgtgtgttggaaaattatctgtc

SEQ ID NO: 15 - DNA, 24 bp, Artificial Sequence
  Description of Artificial Sequence: Synthetic primer
tcttcctctccttgtcttatctcg

SEQ ID NO: 16 - DNA, 25 bp, Artificial Sequence
  Description of Artificial Sequence: Synthetic primer
cattgaaagtatggaaaggaagctc

SEQ ID NO: 17 - DNA, 22 bp, Artificial Sequence
  Description of Artificial Sequence: Synthetic primer
atcttggccaacctgtacactg

SEQ ID NO: 18 - DNA, 22 bp, Artificial Sequence
  Description of Artificial Sequence: Synthetic primer
ctttggcaatgaccagtttctg

SEQ ID NO: 19 - DNA, 20 bp, Artificial Sequence
  Description of Artificial Sequence: Synthetic primer
ctttccaaccctgcaggaag

SEQ ID NO: 20 - DNA, 26 bp, Artificial Sequence
  Description of Artificial Sequence: Synthetic primer
ttcagaaagattagtccgtgtgaaac

SEQ ID NO: 21 - DNA, 22 bp, Artificial Sequence
  Description of Artificial Sequence: Synthetic primer
caaaagcacttgtgttaatgcg

SEQ ID NO: 22 - DNA, 22 bp, Artificial Sequence
  Description of Artificial Sequence: Synthetic primer
tactgccctcactcggaatatg

SEQ ID NO: 23 - DNA, 22 bp, Artificial Sequence
  Description of Artificial Sequence: Synthetic primer
aaagcatatgcacaggttagcg

SEQ ID NO: 24 - DNA, 21 bp, Artificial Sequence
  Description of Artificial Sequence: Synthetic primer
tatggtcaaattcacaggggc

SEQ ID NO: 25 - DNA, 24 bp, Artificial Sequence
  Description of Artificial Sequence: Synthetic primer
tgtgactttcaggttaacaggtgg

SEQ ID NO: 26 - DNA, 21 bp, Artificial Sequence
  Description of Artificial Sequence: Synthetic primer
atgtctgtaggccgcaggttg

SEQ ID NO: 27 - DNA, 23 bp, Artificial Sequence
  Description of Artificial Sequence: Synthetic primer
catgtgtttgaaagccactgttc

SEQ ID NO: 28 - DNA, 27 bp, Artificial Sequence
  Description of Artificial Sequence: Synthetic primer
cctctaccagtaattttattgctcacc

SEQ ID NO: 29 - DNA, 20 bp, Artificial Sequence
  Description of Artificial Sequence: Synthetic primer
tttgctgccaccatcagagg

SEQ ID NO: 30 - DNA, 23 bp, Artificial Sequence
  Description of Artificial Sequence: Synthetic primer
tcagaacctgctctgatggtaac

SEQ ID NO: 31 - DNA, 22 bp, Artificial Sequence
  Description of Artificial Sequence: Synthetic primer
gtgggcctggtttgtctatcag

SEQ ID NO: 32 - DNA, 22 bp, Artificial Sequence
  Description of Artificial Sequence: Synthetic primer
agtgtccgtcacttttggattg

SEQ ID NO: 33 - DNA, 23 bp, Artificial Sequence
  Description of Artificial Sequence: Synthetic primer
tggttatgtctatgactttgggg

SEQ ID NO: 34 - DNA, 22 bp, Artificial Sequence
  Description of Artificial Sequence: Synthetic primer
tggtagtatcagtgacatgcgg

SEQ ID NO: 35 - DNA, 24 bp, Artificial Sequence
  Description of Artificial Sequence: Synthetic primer
ttttagtatggatttgctccaatg

SEQ ID NO: 36 - DNA, 23 bp, Artificial Sequence
  Description of Artificial Sequence: Synthetic primer
gttttctgtgcttgaaagagagg

SEQ ID NO: 37 - DNA, 22 bp, Artificial Sequence
  Description of Artificial Sequence: Synthetic primer
gctggactttgtatttcccagc

SEQ ID NO: 38 - DNA, 21 bp, Artificial Sequence
  Description of Artificial Sequence: Synthetic primer
gcgcttgacactggaattgac

SEQ ID NO: 39 - DNA, 23 bp, Artificial Sequence
  Description of Artificial Sequence: Synthetic primer
ggaaaaggtatgcggaaatactg

SEQ ID NO: 40 - DNA, 22 bp, Artificial Sequence
  Description of Artificial Sequence: Synthetic primer
ctccagtaactttcagaggccc

SEQ ID NO: 41 - DNA, 22 bp, Artificial Sequence
  Description of Artificial Sequence: Synthetic primer
tatgatgtcactcccaccatcc

SEQ ID NO: 42 - DNA, 22 bp, Artificial Sequence
  Description of Artificial Sequence: Synthetic primer
caggttctcctttgccatagtg

SEQ ID NO: 43 - DNA, 22 bp, Artificial Sequence
  Description of Artificial Sequence: Synthetic primer
ggtagaattggggatgacaagg

SEQ ID NO: 44 - DNA, 22 bp, Artificial Sequence
  Description of Artificial Sequence: Synthetic primer
ttgcttatgcaggtgaggattc

SEQ ID NO: 45 - DNA, 26 bp, Artificial Sequence
  Description of Artificial Sequence: Synthetic primer
ccagggttctacttagtatagagggg

SEQ ID NO: 46 - DNA, 20 bp, Artificial Sequence
  Description of Artificial Sequence: Synthetic primer
cattcttggccttcacacgg

SEQ ID NO: 47 - DNA, 22 bp, Artificial Sequence
  Description of Artificial Sequence: Synthetic primer
catcaattgccaagactggttc

SEQ ID NO: 48 - DNA, 25 bp, Artificial Sequence
  Description of Artificial Sequence: Synthetic primer
catttcagtgtgacattgtttcttg

SEQ ID NO: 49 - DNA, 22 bp, Artificial Sequence
  Description of Artificial Sequence: Synthetic primer
accgtcataggtgggtttcttc

SEQ ID NO: 50 - DNA, 22 bp, Artificial Sequence
  Description of Artificial Sequence: Synthetic primer
acatgttcaactgttctcaggg

SEQ ID NO: 51 - DNA, 25 bp, Artificial Sequence
  Description of Artificial Sequence: Synthetic primer
tttatcgaatacttctgtgcttgag

SEQ ID NO: 52 - DNA, 22 bp, Artificial Sequence
  Description of Artificial Sequence: Synthetic primer
taaaggcttgccccataaattg

SEQ ID NO: 53 - DNA, 23 bp, Artificial Sequence
  Description of Artificial Sequence: Synthetic primer
ggatctttgcaaacaactggttc

SEQ ID NO: 54 - DNA, 24 bp, Artificial Sequence
  Description of Artificial Sequence: Synthetic primer
accactgttgttttccacagtaag

SEQ ID NO: 55 - DNA, 22 bp, Artificial Sequence
  Description of Artificial Sequence: Synthetic primer
actttgggaagtggttttccag

SEQ ID NO: 56 - DNA, 26 bp, Artificial Sequence
  Description of Artificial Sequence: Synthetic primer
gaggttcccaagatatgactacaaag

SEQ ID NO: 57 - DNA, 22 bp, Artificial Sequence
  Description of Artificial Sequence: Synthetic primer
cttccaccatcatacttgggtg

SEQ ID NO: 58 - DNA, 21 bp, Artificial Sequence
  Description of Artificial Sequence: Synthetic primer
aaatttgattggtccagtggg

SEQ ID NO: 59 - DNA, 20 bp, Artificial Sequence
  Description of Artificial Sequence: Synthetic primer
tctggtggatcccagcaaac

SEQ ID NO: 60 - DNA, 22 bp, Artificial Sequence
  Description of Artificial Sequence: Synthetic primer
atcggaagcctggactgaagag

SEQ ID NO: 61 - DNA, 20 bp, Artificial Sequence
  Description of Artificial Sequence: Synthetic primer
gtctgatgacgccaccttgc

SEQ ID NO: 62 - DNA, 20 bp, Artificial Sequence
  Description of Artificial Sequence: Synthetic primer
gaccactgtgggaggacctg

SEQ ID NO: 63 - DNA, 22 bp, Artificial Sequence
  Description of Artificial Sequence: Synthetic primer
gaatagtttggggtgtgaaggg

SEQ ID NO: 64 - DNA, 22 bp, Artificial Sequence
  Description of Artificial Sequence: Synthetic primer
ataagtgatgcactggtctggg

SEQ ID NO: 65 - DNA, 22 bp, Artificial Sequence
  Description of Artificial Sequence: Synthetic primer
ctagaattcggctgcctccatc

SEQ ID NO: 66 - DNA, 21 bp, Artificial Sequence
  Description of Artificial Sequence: Synthetic primer
aacatcatcccttgccacaac

SEQ ID NO: 67 - DNA, 22 bp, Artificial Sequence
  Description of Artificial Sequence: Synthetic primer
atgacagatttggactgccacc

SEQ ID NO: 68 - DNA, 22 bp, Artificial Sequence
  Description of Artificial Sequence: Synthetic primer
cggtaggttccactgtcatcag

SEQ ID NO: 69 - DNA, 25 bp, Artificial Sequence
  Description of Artificial Sequence: Synthetic primer
ggtttagaaacctgagaaaaggagg

SEQ ID NO: 70 - DNA, 21 bp, Artificial Sequence
  Description of Artificial Sequence: Synthetic primer
taccattttacaggccagggg

SEQ ID NO: 71 - DNA, 24 bp, Artificial Sequence
  Description of Artificial Sequence: Synthetic primer
caatcaaggtcttcctcatttcac

SEQ ID NO: 72 - DNA, 22 bp, Artificial Sequence
  Description of Artificial Sequence: Synthetic primer
caaggtcaagttcaggtgcttc

SEQ ID NO: 73 - DNA, 22 bp, Artificial Sequence
  Description of Artificial Sequence: Synthetic primer
gtaacaactttgcgcaggtcag

SEQ ID NO: 74 - DNA, 22 bp, Artificial Sequence
  Description of Artificial Sequence: Synthetic primer
accaggatttcctctctgcatc

SEQ ID NO: 75 - DNA, 22 bp, Artificial Sequence
  Description of Artificial Sequence: Synthetic primer
ctcggaccaatactttgccttc

SEQ ID NO: 76 - DNA, 22 bp, Artificial Sequence
  Description of Artificial Sequence: Synthetic primer
tagacgcagatgaggatgattc

SEQ ID NO: 77 - DNA, 22 bp, Artificial Sequence
  Description of Artificial Sequence: Synthetic primer
caactgtgacacgctctgattc

SEQ ID NO: 78 - DNA, 25 bp, Artificial Sequence
  Description of Artificial Sequence: Synthetic primer
tgctgtaacaagtaatttctcctcc

SEQ ID NO: 79 - DNA, 23 bp, Artificial Sequence
  Description of Artificial Sequence: Synthetic primer
gaagtaatttccaaagacgtggg

SEQ ID NO: 80 - DNA, 22 bp, Artificial Sequence
  Description of Artificial Sequence: Synthetic primer
acagacggtcatggagtctttg

SEQ ID NO: 81 - DNA, 21 bp, Artificial Sequence
  Description of Artificial Sequence: Synthetic primer
ccagcagacaaccatcgaatc

SEQ ID NO: 82 - DNA, 24 bp, Artificial Sequence
  Description of Artificial Sequence: Synthetic primer
tcttggagttaccagctctacacc

SEQ ID NO: 83 - DNA, 22 bp, Artificial Sequence
  Description of Artificial Sequence: Synthetic primer
tgaacttcaggtcagcgatagg

SEQ ID NO: 84 - DNA, 26 bp, Artificial Sequence
  Description of Artificial Sequence: Synthetic primer
ggtcggtagtaaaagtcataatcagg

SEQ ID NO: 85 - DNA, 22 bp, Artificial Sequence
  Description of Artificial Sequence: Synthetic primer
tcgaccacttctagctttgcag

SEQ ID NO: 86 - DNA, 27 bp, Artificial Sequence
  Description of Artificial Sequence: Synthetic primer
ggctaacctcaatttcacatgtcttac

SEQ ID NO: 87 - DNA, 22 bp, Artificial Sequence
  Description of Artificial Sequence: Synthetic primer
aacgtctcggaacttgacatcc

SEQ ID NO: 88 - DNA, 23 bp, Artificial Sequence
  Description of Artificial Sequence: Synthetic primer
tcaagtctgaatgtttctccagc

SEQ ID NO: 89 - DNA, 25 bp, Artificial Sequence
  Description of Artificial Sequence: Synthetic primer
gcttcacctgcttttaatataaccg

SEQ ID NO: 90 - DNA, 24 bp, Artificial Sequence
  Description of Artificial Sequence: Synthetic primer
tgaatgtcttctcccacattattc

SEQ ID NO: 91 - DNA, 21 bp, Artificial Sequence
  Description of Artificial Sequence: Synthetic primer
gcccaggaacatcaagaacag

SEQ ID NO: 92 - DNA, 25 bp, Artificial Sequence
  Description of Artificial Sequence: Synthetic primer
ctagggagacttcagtcttgtcaac

SEQ ID NO: 93 - DNA, 26 bp, Artificial Sequence
  Description of Artificial Sequence: Synthetic primer
tggttcattccatttcactagcatac

SEQ ID NO: 94 - DNA, 21 bp, Artificial Sequence
  Description of Artificial Sequence: Synthetic primer
ttgtatggcatcccaaccttc

SEQ ID NO: 95 - DNA, 27 bp, Artificial Sequence
  Description of Artificial Sequence: Synthetic primer
gctgctttcatgcaatataacacttag

SEQ ID NO: 96 - DNA, 22 bp, Artificial Sequence
  Description of Artificial Sequence: Synthetic primer
gagcaaggagtcaggtaaaggg

SEQ ID NO: 97 - DNA, 21 bp, Artificial Sequence
  Description of Artificial Sequence: Synthetic primer
ggagatgaacaaaaggatggg

SEQ ID NO: 98 - DNA, 20 bp, Artificial Sequence
  Description of Artificial Sequence: Synthetic primer
ccttccttcaccctccactg

SEQ ID NO: 99 - DNA, 22 bp, Artificial Sequence
  Description of Artificial Sequence: Synthetic primer
ctacaattgttgcaggctctgg

SEQ ID NO: 100 - DNA, 26 bp, Artificial Sequence
  Description of Artificial Sequence: Synthetic primer
tcatctccaactttctggtactcaac

SEQ ID NO: 101 - DNA, 22 bp, Artificial Sequence
  Description of Artificial Sequence: Synthetic primer
tgctgaagctatgtcccatttc

SEQ ID NO: 102 - DNA, 22 bp, Artificial Sequence
  Description of Artificial Sequence: Synthetic primer
ggccttggatagcctgtacttg

SEQ ID NO: 103 - DNA, 22 bp, Artificial Sequence
  Description of Artificial Sequence: Synthetic primer
aaaagcagctgacttgatcacc

SEQ ID NO: 104 - DNA, 24 bp, Artificial Sequence
  Description of Artificial Sequence: Synthetic primer
ccacagttgacatgagagaaacag

SEQ ID NO: 105 - DNA, 22 bp, Artificial Sequence
  Description of Artificial Sequence: Synthetic primer
ctcaccaagttatgctgcatgg

SEQ ID NO: 106 - DNA, 22 bp, Artificial Sequence
  Description of Artificial Sequence: Synthetic primer
agggccaatgcgttgtattaag

SEQ ID NO: 107 - DNA, 20 bp, Artificial Sequence
  Description of Artificial Sequence: Synthetic primer
gataagactgggctggggtg

SEQ ID NO: 108 - DNA, 23 bp, Artificial Sequence
  Description of Artificial Sequence: Synthetic primer
tctcatgatgtgaaatggtcagc

SEQ ID NO: 109 - DNA, 24 bp, Artificial Sequence
  Description of Artificial Sequence: Synthetic primer
ggggcatctatagtgatcataacc

SEQ ID NO: 110 - DNA, 25 bp, Artificial Sequence
  Description of Artificial Sequence: Synthetic primer
tcaactcctcctttctgtagaccag

SEQ ID NO: 111 - DNA, 23 bp, Artificial Sequence
  Description of Artificial Sequence: Synthetic primer
tgtttggagtgagggttagaagg

SEQ ID NO: 112 - DNA, 22 bp, Artificial Sequence
  Description of Artificial Sequence: Synthetic primer
atgcaacaacaatgaggacaac

SEQ ID NO: 113 - DNA, 22 bp, Artificial Sequence
  Description of Artificial Sequence: Synthetic primer
agtaagcaatcattggtgctgc

SEQ ID NO: 114 - DNA, 22 bp, Artificial Sequence
  Description of Artificial Sequence: Synthetic primer
ctagcatcagctgagtgagacc

SEQ ID NO: 115 - DNA, 25 bp, Artificial Sequence
  Description of Artificial Sequence: Synthetic primer
aagaatcaatcttccactccatcag

SEQ ID NO: 116 - DNA, 24 bp, Artificial Sequence
  Description of Artificial Sequence: Synthetic primer
ttgttacacagcatacagcatagc

SEQ ID NO: 117 - DNA, 22 bp, Artificial Sequence
  Description of Artificial Sequence: Synthetic primer
acatctacaggtggatcagggg

SEQ ID NO: 118 - DNA, 22 bp, Artificial Sequence
  Description of Artificial Sequence: Synthetic primer
gaaatgaaagaccctcacaagg

SEQ ID NO: 119 - DNA, 23 bp, Artificial Sequence
  Description of Artificial Sequence: Synthetic primer
tcaccatctttgaaccatttcac

SEQ ID NO: 120 - DNA, 23 bp, Artificial Sequence
  Description of Artificial Sequence: Synthetic primer
ttctgtgggtccaaagttttatg

SEQ ID NO: 121 - DNA, 26 bp, Artificial Sequence
  Description of Artificial Sequence: Synthetic primer
ggctaacaggctatggatgtatttag

SEQ ID NO: 122 - DNA, 24 bp, Artificial Sequence
  Description of Artificial Sequence: Synthetic primer
tgagcgcatacagggtagaaatac

SEQ ID NO: 123 - DNA, 22 bp, Artificial Sequence
  Description of Artificial Sequence: Synthetic primer
ctctctctcaagcacacccacc

SEQ ID NO: 124 - DNA, 27 bp, Artificial Sequence
  Description of Artificial Sequence: Synthetic primer
acagaagttaatgggattgagaataac

SEQ ID NO: 125 - DNA, 26 bp, Artificial Sequence
  Description of Artificial Sequence: Synthetic primer
gcactgcaaagttaactaatttcctc

SEQ ID NO: 126 - DNA, 22 bp, Artificial Sequence
  Description of Artificial Sequence: Synthetic primer
actcatcatccagcctgcaatc

SEQ ID NO: 127 - DNA, 23 bp, Artificial Sequence
  Description of Artificial Sequence: Synthetic primer
tgtaatactgggaaacgaggtcc

SEQ ID NO: 128 - DNA, 22 bp, Artificial Sequence
  Description of Artificial Sequence: Synthetic primer
aaaggtggtcctttctatcgcc

SEQ ID NO: 129 - DNA, 23 bp, Artificial Sequence
  Description of Artificial Sequence: Synthetic primer
ggaactagaaggcaaagagccag

SEQ ID NO: 130 - DNA, 20 bp, Artificial Sequence
  Description of Artificial Sequence: Synthetic primer
cacaacatttgccattgacc

SEQ ID NO: 131 - DNA, 22 bp, Artificial Sequence
  Description of Artificial Sequence: Synthetic primer
atactgccctatgtggctctgg

SEQ ID NO: 132 - DNA, 22 bp, Artificial Sequence
  Description of Artificial Sequence: Synthetic primer
ccatcatctttaggtggaaacc

SEQ ID NO: 133 - DNA, 22 bp, Artificial Sequence
  Description of Artificial Sequence: Synthetic primer
tccatttctcagtgcctactgg

SEQ ID NO: 134 - DNA, 22 bp, Artificial Sequence
  Description of Artificial Sequence: Synthetic primer
ttttctgaaagcaaccgacaag

SEQ ID NO: 135 - DNA, 26 bp, Artificial Sequence
  Description of Artificial Sequence: Synthetic primer
tgcaagttgctactaaggtttgttac

SEQ ID NO: 136 - DNA, 22 bp, Artificial Sequence
  Description of Artificial Sequence: Synthetic primer
ttggttgagcttctacttgggg

SEQ ID NO: 137 - DNA, 26 bp, Artificial Sequence
  Description of Artificial Sequence: Synthetic primer
ccaccaacatataaacagtatgaccc

SEQ ID NO: 138 - DNA, 21 bp, Artificial Sequence
  Description of Artificial Sequence: Synthetic primer
tagcgctagcgatgtgtggac

SEQ ID NO: 139 - DNA, 23 bp, Artificial Sequence
  Description of Artificial Sequence: Synthetic primer
tcagtcatgccatgtaaaagagg

SEQ ID NO: 140 - DNA, 21 bp, Artificial Sequence
  Description of Artificial Sequence: Synthetic primer
ctggattgactttggtccagg

SEQ ID NO: 141 - DNA, 21 bp, Artificial Sequence
  Description of Artificial Sequence: Synthetic primer
tcgttttgtcacatcaaccac

SEQ ID NO: 142 - DNA, 26 bp, Artificial Sequence
  Description of Artificial Sequence: Synthetic primer
aagtaaagtggtgaccagagaagttg

SEQ ID NO: 143 - DNA, 23 bp, Artificial Sequence
  Description of Artificial Sequence: Synthetic primer
ttccccttgaatatgaactttgg

SEQ ID NO: 144 - DNA, 22 bp, Artificial Sequence
  Description of Artificial Sequence: Synthetic primer
tgtggcattgagaagagaaagg

SEQ ID NO: 145 - DNA, 26 bp, Artificial Sequence
  Description of Artificial Sequence: Synthetic primer
tggtagatgttcactgaatttgtgtc

SEQ ID NO: 146 - DNA, 22 bp, Artificial Sequence
  Description of Artificial Sequence: Synthetic primer
agcctacaaattgcagatgagc

SEQ ID NO: 147 - DNA, 22 bp, Artificial Sequence
  Description of Artificial Sequence: Synthetic primer
gctgcctttaaaccacttgacc

SEQ ID NO: 148 - DNA, 25 bp, Artificial Sequence
  Description of Artificial Sequence: Synthetic primer
tccatcctattagaaaaggagacag

SEQ ID NO: 149 - DNA, 27 bp, Artificial Sequence
  Description of Artificial Sequence: Synthetic primer
tcattaagaagtaatgtagccaggagg

SEQ ID NO: 150 - DNA, 25 bp, Artificial Sequence
  Description of Artificial Sequence: Synthetic primer
gcaggagctagttatttaccaaagc

SEQ ID NO: 151 - DNA, 24 bp, Artificial Sequence
  Description of Artificial Sequence: Synthetic primer
gggcttgaattttaatcaagtgtg

SEQ ID NO: 152 - DNA, 22 bp, Artificial Sequence
  Description of Artificial Sequence: Synthetic primer
ttggtagaacttcccttggacc

SEQ ID NO: 153 - DNA, 25 bp, Artificial Sequence
  Description of Artificial Sequence: Synthetic primer
tgtggaagaagaagagactttgagg

SEQ ID NO: 154 - DNA, 26 bp, Artificial Sequence
  Description of Artificial Sequence: Synthetic primer
ggattacttaagcagaattttaagcc

SEQ ID NO: 155 - DNA, 22 bp, Artificial Sequence
  Description of Artificial Sequence: Synthetic primer
atgtggggaagggtagttttgc

SEQ ID NO: 156 - DNA, 22 bp, Artificial Sequence
  Description of Artificial Sequence: Synthetic primer
agactgttgggagtttgaagcc

SEQ ID NO: 157 - DNA, 21 bp, Artificial Sequence
  Description of Artificial Sequence: Synthetic primer
tctgcagcaactctgaagatg

SEQ ID NO: 158 - DNA, 20 bp, Artificial Sequence
  Description of Artificial Sequence: Synthetic primer
gcggaaagagaaaggcaaag

SEQ ID NO: 159 - DNA, 27 bp, Artificial Sequence
  Description of Artificial Sequence: Synthetic primer
gagtgagatggtaaagaaaattaagcc

SEQ ID NO: 160 - DNA, 26 bp, Artificial Sequence
  Description of Artificial Sequence: Synthetic primer
gagggatccattgctatgtgtataag

SEQ ID NO: 161 - DNA, 22 bp, Artificial Sequence
  Description of Artificial Sequence: Synthetic primer
gggtggacagacacttttgttc

SEQ ID NO: 162 - DNA, 22 bp, Artificial Sequence
  Description of Artificial Sequence: Synthetic primer
tgtcctgcatcctctactgtgc

SEQ ID NO: 163 - DNA, 23 bp, Artificial Sequence
  Description of Artificial Sequence: Synthetic primer
aattagatgcttctggactcccc

SEQ ID NO: 164 - DNA, 20 bp, Artificial Sequence
  Description of Artificial Sequence: Synthetic primer
gccatggtcttttcgcagtg

SEQ ID NO: 165 - DNA, 22 bp, Artificial Sequence
  Description of Artificial Sequence: Synthetic primer
aagacgttcacttccaccacag

SEQ ID NO: 166 - DNA, 25 bp, Artificial Sequence
  Description of Artificial Sequence: Synthetic primer
tttgaaccacttctgtattggaatg

SEQ ID NO: 167 - DNA, 23 bp, Artificial Sequence
  Description of Artificial Sequence: Synthetic primer
agaaagcagacaatggaaaacag

SEQ ID NO: 168 - DNA, 25 bp, Artificial Sequence
  Description of Artificial Sequence: Synthetic primer
gctactgagaaagatttggaacacc

SEQ ID NO: 169 - DNA, 23 bp, Artificial Sequence
  Description of Artificial Sequence: Synthetic primer
ttacgcacaactttgaactctgg

SEQ ID NO: 170 - DNA, 22 bp, Artificial Sequence
  Description of Artificial Sequence: Synthetic primer
tcactgctacctttgaaccagc

SEQ ID NO: 171 - DNA, 23 bp, Artificial Sequence
  Description of Artificial Sequence: Synthetic primer
tgttgcctccaacactaatacac

SEQ ID NO: 172 - DNA, 20 bp, Artificial Sequence
  Description of Artificial Sequence: Synthetic primer
catttgtgccaaccaactgc

SEQ ID NO: 173 - DNA, 22 bp, Artificial Sequence
  Description of Artificial Sequence: Synthetic primer
ttaaattttccccaacaaagcc

SEQ ID NO: 174 - DNA, 22 bp, Artificial Sequence
  Description of Artificial Sequence: Synthetic primer
tcctgcatccactctgactttc

SEQ ID NO: 175 - DNA, 22 bp, Artificial Sequence
  Description of Artificial Sequence: Synthetic primer
gcgaaccaattcaaagaaaacc

SEQ ID NO: 176 - DNA, 24 bp, Artificial Sequence
  Description of Artificial Sequence: Synthetic primer
tgagtgtcctgtgtggatagaacc

SEQ ID NO: 177 - DNA, 26 bp, Artificial Sequence
  Description of Artificial Sequence: Synthetic primer
gaggagactccacaactttcaataag

SEQ ID NO: 178 - DNA, 22 bp, Artificial Sequence
  Description of Artificial Sequence: Synthetic primer
ttgctgattcagaagatgtcgg

SEQ ID NO: 179 - DNA, 21 bp, Artificial Sequence
  Description of Artificial Sequence: Synthetic primer
gtgggttggaagctgagcaag

SEQ ID NO: 180 - DNA, 20 bp, Artificial Sequence
  Description of Artificial Sequence: Synthetic primer
ctccagaggttccagttccg

SEQ ID NO: 181 - DNA, 20 bp, Artificial Sequence
  Description of Artificial Sequence: Synthetic primer
tgggtggttctgaagaaggg

SEQ ID NO: 182 - DNA, 22 bp, Artificial Sequence
  Description of Artificial Sequence: Synthetic primer
gaaatgctcatttggtgtaccg

SEQ ID NO: 183 - DNA, 22 bp, Artificial Sequence
  Description of Artificial Sequence: Synthetic primer
tctgcaatttgtgaaagggatg

SEQ ID NO: 184 - DNA, 27 bp, Artificial Sequence
  Description of Artificial Sequence: Synthetic primer
caacttcaacatttactttgcatcttg

SEQ ID NO: 185 - DNA, 18 bp, Artificial Sequence
  Description of Artificial Sequence: Synthetic primer
ctaccccatggctctgtg

SEQ ID NO: 186 - DNA, 25 bp, Artificial Sequence
  Description of Artificial Sequence: Synthetic primer
tttttattaggaaaaatgaccatca

SEQ ID NO: 187 - DNA, 18 bp, Artificial Sequence
  Description of Artificial Sequence: Synthetic primer
gctggagagcctccgatg

SEQ ID NO: 188 - DNA, 22 bp, Artificial Sequence
  Description of Artificial Sequence: Synthetic primer
aaacctttcacaaagagacggg

SEQ ID NO: 189 - DNA, 22 bp, Artificial Sequence
  Description of Artificial Sequence: Synthetic primer
ttcttccatggggtaagaaagc

SEQ ID NO: 190 - DNA, 22 bp, Artificial Sequence
  Description of Artificial Sequence: Synthetic primer
gtggacgacctagtgattcctg

SEQ ID NO: 191 - DNA, 25 bp, Artificial Sequence
  Description of Artificial Sequence: Synthetic primer
cagtatgcaataaaacaaacagcag

SEQ ID NO: 192 - DNA, 22 bp, Artificial Sequence
  Description of Artificial Sequence: Synthetic primer
gccattttagccctcgattttc

SEQ ID NO: 193 - DNA, 23 bp, Artificial Sequence
  Description of Artificial Sequence: Synthetic primer
atggacctaccgtattcatcctt

SEQ ID NO: 194 - DNA, 24 bp, Artificial Sequence
  Description of Artificial Sequence: Synthetic primer
ttgggtatccaaatttttatcttg

SEQ ID NO: 195 - DNA, 25 bp, Artificial Sequence
  Description of Artificial Sequence: Synthetic primer
agaaaatctattcaaatgcgaggtg

SEQ ID NO: 196 - DNA, 22 bp, Artificial Sequence
  Description of Artificial Sequence: Synthetic primer
gtggtttggtactttgctccac

SEQ ID NO: 197 - DNA, 24 bp, Artificial Sequence
  Description of Artificial Sequence: Synthetic primer
tgaaagcattgtgtaagtaatggg

SEQ ID NO: 198 - DNA, 22 bp, Artificial Sequence
  Description of Artificial Sequence: Synthetic primer
aaaggcttttcctcacttgctg

SEQ ID NO: 199 - DNA, 22 bp, Artificial Sequence
  Description of Artificial Sequence: Synthetic primer
ttgtgatggaggagaagctgac

SEQ ID NO: 200 - DNA, 25 bp, Artificial Sequence
  Description of Artificial Sequence: Synthetic primer
tctttaaacacataaaggatcaggt

SEQ ID NO: 201 - DNA, 30 bp, Artificial Sequence
  Description of Artificial Sequence: Synthetic primer
tagaattagtaaactagtcttgtggaaacc

SEQ ID NO: 202 - DNA, 25 bp, Artificial Sequence
  Description of Artificial Sequence: Synthetic primer
gaaactgatctttgcaaacgtgtat

SEQ ID NO: 203 - DNA, 18 bp, Artificial Sequence
  Description of Artificial Sequence: Synthetic primer
cacctggccctgctcaat

SEQ ID NO: 204 - DNA, 22 bp, Artificial Sequence
  Description of Artificial Sequence: Synthetic primer
gattgtccagatcatgcgagag

SEQ ID NO: 205 - DNA, 26 bp, Artificial Sequence
  Description of Artificial Sequence: Synthetic primer
aaagtgtactgactgaattgtttgcc

SEQ ID NO: 206 - DNA, 26 bp, Artificial Sequence
  Description of Artificial Sequence: Synthetic primer
tgtgttttatttgagtgtgaaactgc

SEQ ID NO: 207 - DNA, 21 bp, Artificial Sequence
  Description of Artificial Sequence: Synthetic primer
cactgggaaaggacaaaagcc

SEQ ID NO: 208 - DNA, 22 bp, Artificial Sequence
  Description of Artificial Sequence: Synthetic primer
tgagttaatgtgcactgaagga

SEQ ID NO: 209 - DNA, 21 bp, Artificial Sequence
  Description of Artificial Sequence: Synthetic primer
aaagagttgcatcccaaagag

SEQ ID NO: 210 - DNA, 25 bp, Artificial Sequence
  Description of Artificial Sequence: Synthetic primer
ggcagcatagtacatatgaagatcg

SEQ ID NO: 211 - DNA, 27 bp, Artificial Sequence
  Description of Artificial Sequence: Synthetic primer
agcattccttgatatatttgtttctaa

SEQ ID NO: 212 - DNA, 22 bp, Artificial Sequence
  Description of Artificial Sequence: Synthetic primer
taatacccaggggagaaggtgg

SEQ ID NO: 213 - DNA, 23 bp, Artificial Sequence
  Description of Artificial Sequence: Synthetic primer
tttcccacacatgtacagaaagc

SEQ ID NO: 214 - DNA, 25 bp, Artificial Sequence
  Description of Artificial Sequence: Synthetic primer
cattttccttttctgatctaccaag

SEQ ID NO: 215 - DNA, 23 bp, Artificial Sequence
  Description of Artificial Sequence: Synthetic primer
tggactttcctttctgagaccag

SEQ ID NO: 216 - DNA, 23 bp, Artificial Sequence
  Description of Artificial Sequence: Synthetic primer
accaaagacacagtcagacagaa

SEQ ID NO: 217 - DNA, 26 bp, Artificial Sequence
  Description of Artificial Sequence: Synthetic primer
tcttccaaactgaacacaaaatttac

SEQ ID NO: 218 - DNA, 28 bp, Artificial Sequence
  Description of Artificial Sequence: Synthetic primer
ttacaagaatttagtgacttaaacagga

SEQ ID NO: 219 - DNA, 29 bp, Artificial Sequence
  Description of Artificial Sequence: Synthetic primer
gtatgcacactgtgactaaatctattatt

SEQ ID NO: 220 - DNA, 26 bp, Artificial Sequence
  Description of Artificial Sequence: Synthetic primer
acaaaggcaagagtgatacatttaag

SEQ ID NO: 221 - DNA, 25 bp, Artificial Sequence
  Description of Artificial Sequence: Synthetic primer
aagtgaaaatttaagtgatgcaagc

SEQ ID NO: 222 - DNA, 22 bp, Artificial Sequence
  Description of Artificial Sequence: Synthetic primer
caactgcccctgaattgttttc

SEQ ID NO: 223 - DNA, 22 bp, Artificial Sequence
  Description of Artificial Sequence: Synthetic primer
cttcgtctgaagcatgagttcg

SEQ ID NO: 224 - DNA, 25 bp, Artificial Sequence
  Description of Artificial Sequence: Synthetic primer
agagacatgtgcttttaagtttcac

SEQ ID NO: 225 - DNA, 25 bp, Artificial Sequence
  Description of Artificial Sequence: Synthetic primer
gattagttttagtgtctggatgctt

SEQ ID NO: 226 - DNA, 21 bp, Artificial Sequence
  Description of Artificial Sequence: Synthetic primer
tggcattgttcatgagcctct

SEQ ID NO: 227 - DNA, 29 bp, Artificial Sequence
  Description of Artificial Sequence: Synthetic primer
atgttttgatctatagggacaaacaatgc

SEQ ID NO: 228 - DNA, 22 bp, Artificial Sequence
  Description of Artificial Sequence: Synthetic primer
tgggaactatttgtttcccgtc

SEQ ID NO: 229 - DNA, 24 bp, Artificial Sequence
  Description of Artificial Sequence: Synthetic primer
aacttctggttcagtaatgggttc

SEQ ID NO: 230 - DNA, 27 bp, Artificial Sequence
  Description of Artificial Sequence: Synthetic primer
ttccatattggttaaatagcacacaag

SEQ ID NO: 231 - DNA, 22 bp, Artificial Sequence
  Description of Artificial Sequence: Synthetic primer
cacaatgtgaaccctgtcactg

SEQ ID NO: 232 - DNA, 29 bp, Artificial Sequence
  Description of Artificial Sequence: Synthetic primer
gatgctattttgttaatacacagatctta

SEQ ID NO: 233 - DNA, 23 bp, Artificial Sequence
  Description of Artificial Sequence: Synthetic primer
aactgttgcagacacttcagtcc

SEQ ID NO: 234 - DNA, 27 bp, Artificial Sequence
  Description of Artificial Sequence: Synthetic primer
gaaaccatagttttaagagcagaggac

SEQ ID NO: 235 - DNA, 26 bp, Artificial Sequence
  Description of Artificial Sequence: Synthetic primer
ttctggtaattcaaagggaatatgtg

SEQ ID NO: 236 - DNA, 22 bp, Artificial Sequence
  Description of Artificial Sequence: Synthetic primer
aatgaatgatggtggttctgtg

SEQ ID NO: 237 - DNA, 24 bp, Artificial Sequence
  Description of Artificial Sequence: Synthetic primer
cagtacctgcttttcttcaagtgc

SEQ ID NO: 238 - DNA, 23 bp, Artificial Sequence
  Description of Artificial Sequence: Synthetic primer
tgtcctcttgcttgggtattttc

SEQ ID NO: 239 - DNA, 23 bp, Artificial Sequence
  Description of Artificial Sequence: Synthetic primer
ttttaccacatgctaagggtgac

SEQ ID NO: 240 - DNA, 22 bp, Artificial Sequence
  Description of Artificial Sequence: Synthetic primer
cagagatgtacctcggactctg

SEQ ID NO: 241 - DNA, 21 bp, Artificial Sequence
  Description of Artificial Sequence: Synthetic primer
tttgactgtcagatgcccact

SEQ ID NO: 242 - DNA, 20 bp, Artificial Sequence
  Description of Artificial Sequence: Synthetic primer
tcccaatttgctggagatgt

SEQ ID NO: 243 - DNA, 26 bp, Artificial Sequence
  Description of Artificial Sequence: Synthetic primer
caccttcaggctatactacaaaatga

SEQ ID NO: 244 - DNA, 20 bp, Artificial Sequence
  Description of Artificial Sequence: Synthetic primer
cagctgctcctcccaacatc

SEQ ID NO: 245 - DNA, 21 bp, Artificial Sequence
  Description of Artificial Sequence: Synthetic primer
aggttgggagatggttccttg

SEQ ID NO: 246 - DNA, 24 bp, Artificial Sequence
  Description of Artificial Sequence: Synthetic primer
aagtccatgccaaacaaactattg

SEQ ID NO: 247 - DNA, 23 bp, Artificial Sequence
  Description of Artificial Sequence: Synthetic primer
gactggaggtttctccagctatg

SEQ ID NO: 248 - DNA, 20 bp, Artificial Sequence
  Description of Artificial Sequence: Synthetic primer
gcccccataaccagtgtatt

SEQ ID NO: 249 - DNA, 25 bp, Artificial Sequence
  Description of Artificial Sequence: Synthetic primer
gacaacaagagggataaaaatctgc

SEQ ID NO: 250 - DNA, 26 bp, Artificial Sequence
  Description of Artificial Sequence: Synthetic primer
ggtaaaggtgattatctgtgttgacc

SEQ ID NO: 251 - DNA, 25 bp, Artificial Sequence
  Description of Artificial Sequence: Synthetic primer
ctcataactttgctaagagcccaaa

SEQ ID NO: 252 - DNA, 23 bp, Artificial Sequence
  Description of Artificial Sequence: Synthetic primer
gggagctggtactctcgatcttc

SEQ ID NO: 253 - DNA, 20 bp, Artificial Sequence
  Description of Artificial Sequence: Synthetic primer
ttgataaacctgggaggccc

SEQ ID NO: 254 - DNA, 22 bp, Artificial Sequence
  Description of Artificial Sequence: Synthetic primer
ttccacaaggaatatgcacagc

SEQ ID NO: 255 - DNA, 23 bp, Artificial Sequence
  Description of Artificial Sequence: Synthetic primer
tttcatgggtaattctttcagcc

SEQ ID NO: 256 - DNA, 24 bp, Artificial Sequence
  Description of Artificial Sequence: Synthetic primer
ttttcctaaaacccagtttcatca

SEQ ID NO: 257 - DNA, 23 bp, Artificial Sequence
  Description of Artificial Sequence: Synthetic primer
tgatgaaaatgtaggtgatttgc

SEQ ID NO: 258 - DNA, 24 bp, Artificial Sequence
  Description of Artificial Sequence: Synthetic primer
catactgaaacgatctttggcttt

SEQ ID NO: 259 - DNA, 27 bp, Artificial Sequence
  Description of Artificial Sequence: Synthetic primer
gccagtaactcttagtaattcattcca

SEQ ID NO: 260 - DNA, 21 bp, Artificial Sequence
  Description of Artificial Sequence: Synthetic primer
accactgtcttcgatgccaac

SEQ ID NO: 261 - DNA, 23 bp, Artificial Sequence
  Description of Artificial Sequence: Synthetic primer
cgggaactgtcactattttcacc

SEQ ID NO: 262 - DNA, 22 bp, Artificial Sequence
  Description of Artificial Sequence: Synthetic primer
ttgaatttgcatggcagaaaag

SEQ ID NO: 263 - DNA, 22 bp, Artificial Sequence
  Description of Artificial Sequence: Synthetic primer
ttctctgtaagcctttcctccc

SEQ ID NO: 264 - DNA, 25 bp, Artificial Sequence
  Description of Artificial Sequence: Synthetic primer
gctcatggatatataacaggcagtg

SEQ ID NO: 265 - DNA, 25 bp, Artificial Sequence
  Description of Artificial Sequence: Synthetic primer
cccacattttatttatccattcatt

SEQ ID NO: 266 - DNA, 20 bp, Artificial Sequence
  Description of Artificial Sequence: Synthetic primer
aatcctccattggcctaccc

SEQ ID NO: 267 - DNA, 21 bp, Artificial Sequence
  Description of Artificial Sequence: Synthetic primer
aaaatttgagctgggcaacat

SEQ ID NO: 268 - DNA, 22 bp, Artificial Sequence
  Description of Artificial Sequence: Synthetic primer
cctttcaactaaagcctccaca

SEQ ID NO: 269 - DNA, 27 bp, Artificial Sequence
  Description of Artificial Sequence: Synthetic primer
atttcacatgatatgtggtattaatgt

SEQ ID NO: 270 - DNA, 24 bp, Artificial Sequence
  Description of Artificial Sequence: Synthetic primer
aaggcagaattatccatttagtga

SEQ ID NO: 271 - DNA, 23 bp, Artificial Sequence
  Description of Artificial Sequence: Synthetic primer
gacagttctccctgaaagagcat

SEQ ID NO: 272 - DNA, 24 bp, Artificial Sequence
  Description of Artificial Sequence: Synthetic primer
catctttgaaccaggaaaccttag

SEQ ID NO: 273 - DNA, 23 bp, Artificial Sequence
  Description of Artificial Sequence: Synthetic primer
tcaaatgtgtgtttctgctttgg

SEQ ID NO: 274 - DNA, 24 bp, Artificial Sequence
  Description of Artificial Sequence: Synthetic primer
gagtccattccactgaaacacttt

SEQ ID NO: 275 - DNA, 23 bp, Artificial Sequence
  Description of Artificial Sequence: Synthetic primer
agggattttaaaaggcaaataca

SEQ ID NO: 276 - DNA, 24 bp, Artificial Sequence
  Description of Artificial Sequence: Synthetic primer
atggcatcaaaccagagtcatgta

SEQ ID NO: 277 - DNA, 24 bp, Artificial Sequence
  Description of Artificial Sequence: Synthetic primer
tccgtccttcagtcagtatttcat

SEQ ID NO: 278 - DNA, 25 bp, Artificial Sequence
  Description of Artificial Sequence: Synthetic primer
ttaaaagaattttatgcaaagatgg

SEQ ID NO: 279 - DNA, 24 bp, Artificial Sequence
  Description of Artificial Sequence: Synthetic primer
ttttggtcgtttcagatttgtgag

SEQ ID NO: 280 - DNA, 27 bp, Artificial Sequence
  Description of Artificial Sequence: Synthetic primer
ttgttacagacattgttaagattcgat

SEQ ID NO: 281 - DNA, 21 bp, Artificial Sequence
  Description of Artificial Sequence: Synthetic primer
tgcagctggctgtaatgtgat

SEQ ID NO: 282 - DNA, 29 bp, Artificial Sequence
  Description of Artificial Sequence: Synthetic primer
tttattttaattgataggcctaatatctg

SEQ ID NO: 283 - DNA, 20 bp, Artificial Sequence
  Description of Artificial Sequence: Synthetic primer
tgcaaatcaggttcatagca

SEQ ID NO: 284 - DNA, 24 bp, Artificial Sequence
  Description of Artificial Sequence: Synthetic primer
tgcatgctacagatctcacaaatc

SEQ ID NO: 285 - DNA, 20 bp, Artificial Sequence
  Description of Artificial Sequence: Synthetic primer
gttgactgtggatgcggaac

SEQ ID NO: 286 - DNA, 25 bp, Artificial Sequence
  Description of Artificial Sequence: Synthetic primer
ttttaaaacgataacgatcaagatt

SEQ ID NO: 287 - DNA, 22 bp, Artificial Sequence
  Description of Artificial Sequence: Synthetic primer
gagtttcatggcagaaatccag

SEQ ID NO: 288 - DNA, 24 bp, Artificial Sequence
  Description of Artificial Sequence: Synthetic primer
taaggtcttcctctgttgtaaagg

SEQ ID NO: 289 - DNA, 23 bp, Artificial Sequence
  Description of Artificial Sequence: Synthetic primer
aggaattttgggggaaatgaata

SEQ ID NO: 290 - DNA, 26 bp, Artificial Sequence
  Description of Artificial Sequence: Synthetic primer
agaatttaacacactcgaagattttt

SEQ ID NO: 291 - DNA, 30 bp, Artificial Sequence
  Description of Artificial Sequence: Synthetic primer
atgatacatgatcaccttctaaaatacttc

SEQ ID NO: 292 - DNA, 21 bp, Artificial Sequence
  Description of Artificial Sequence: Synthetic primer
actgtggcaaggagctatgat

SEQ ID NO: 293 - DNA, 25 bp, Artificial Sequence
  Description of Artificial Sequence: Synthetic primer
ctttctcgtttcaaaacctagttcc

SEQ ID NO: 294 - DNA, 22 bp, Artificial Sequence
  Description of Artificial Sequence: Synthetic primer
ttagaacttggcgtcctatctt

SEQ ID NO: 295 - DNA, 21 bp, Artificial Sequence
  Description of Artificial Sequence: Synthetic primer
gactggactgggcttcttaat

SEQ ID NO: 296 - DNA, 24 bp, Artificial Sequence
  Description of Artificial Sequence: Synthetic primer
gacagctttcttcagcacttcaaa

SEQ ID NO: 297 - DNA, 24 bp, Artificial Sequence
  Description of Artificial Sequence: Synthetic primer
tagatcctgaatattggatgtggt

SEQ ID NO: 298 - DNA, 18 bp, Artificial Sequence
  Description of Artificial Sequence: Synthetic primer
ccgagctcatcacttgaa

SEQ ID NO: 299 - DNA, 21 bp, Artificial Sequence
  Description of Artificial Sequence: Synthetic primer
tggccccatttagacacaaac

SEQ ID NO: 300 - DNA, 22 bp, Artificial Sequence
  Description of Artificial Sequence: Synthetic primer
tcatttcagatggctggataga

SEQ ID NO: 301 - DNA, 30 bp, Artificial Sequence
  Description of Artificial Sequence: Synthetic primer
agctaggttattgtctattttcaatgtaat

SEQ ID NO: 302 - DNA, 26 bp, Artificial Sequence
  Description of Artificial Sequence: Synthetic primer
tcccaaggaatactaaagagtaaaca

SEQ ID NO: 303 - DNA, 30 bp, Artificial Sequence
  Description of Artificial Sequence: Synthetic primer
agacagttatgcaaatgtgaaggtattatt

SEQ ID NO: 304 - DNA, 18 bp, Artificial Sequence
  Description of Artificial Sequence: Synthetic primer
tgagcccccatcatctgc

SEQ ID NO: 305 - DNA, 27 bp, Artificial Sequence
  Description of Artificial Sequence: Synthetic primer
aaccagcttaaattgatcttacattcc

SEQ ID NO: 306 - DNA, 29 bp, Artificial Sequence
  Description of Artificial Sequence: Synthetic primer
tttctgtgcaatatggttttaacataaat

SEQ ID NO: 307 - DNA, 27 bp, Artificial Sequence
  Description of Artificial Sequence: Synthetic primer
ggttagaaaatgtaaaagggaaacatt

SEQ ID NO: 308 - DNA, 19 bp, Artificial Sequence
  Description of Artificial Sequence: Synthetic primer
tcatgggcagcattacgaa

SEQ ID NO: 309 - DNA, 26 bp, Artificial Sequence
  Description of Artificial Sequence: Synthetic primer
ggaaggaagaagaacaaagcttaaat

SEQ ID NO: 310 - DNA, 18 bp, Artificial Sequence
  Description of Artificial Sequence: Synthetic primer
cagcaaacggacagcact

SEQ ID NO: 311 - DNA, 21 bp, Artificial Sequence
  Description of Artificial Sequence: Synthetic primer
tccagagccagagatcaataa

SEQ ID NO: 312 - DNA, 24 bp, Artificial Sequence
  Description of Artificial Sequence: Synthetic primer
aatatgttgatttcctggggtaaa

SEQ ID NO: 313 - DNA, 25 bp, Artificial Sequence
  Description of Artificial Sequence: Synthetic primer
gcacagaaaccatattgtggaaaag

SEQ ID NO: 314 - DNA, 24 bp, Artificial Sequence
  Description of Artificial Sequence: Synthetic primer
caaaaaggtgaattttcccacata

SEQ ID NO: 315 - DNA, 22 bp, Artificial Sequence
  Description of Artificial Sequence: Synthetic primer
ccagagcacaagagatagatca

SEQ ID NO: 316 - DNA, 24 bp, Artificial Sequence
  Description of Artificial Sequence: Synthetic primer
ctactctaggcttcatgcacgtat

SEQ ID NO: 317 - DNA, 23 bp, Artificial Sequence
  Description of Artificial Sequence: Synthetic primer
cacttgtgggcagtcatacaaaa

SEQ ID NO: 318 - DNA, 25 bp, Artificial Sequence
  Description of Artificial Sequence: Synthetic primer
atgaagaagcttatgaaaggcaaat

SEQ ID NO: 319 - DNA, 28 bp, Artificial Sequence
  Description of Artificial Sequence: Synthetic primer
tgtgaactattattgaacacctaggaag

SEQ ID NO: 320 - DNA, 21 bp, Artificial Sequence
  Description of Artificial Sequence: Synthetic primer
gagcacaaccgtcattgagtg

SEQ ID NO: 321 - DNA, 22 bp, Artificial Sequence
  Description of Artificial Sequence: Synthetic primer
ccagagcagaagagatacatca

SEQ ID NO: 322 - DNA, 23 bp, Artificial Sequence
  Description of Artificial Sequence: Synthetic primer
tgattccctaagggtaagattgt

SEQ ID NO: 323 - DNA, 25 bp, Artificial Sequence
  Description of Artificial Sequence: Synthetic primer
atgcttaaatcatccataaggttcc

SEQ ID NO: 324 - DNA, 25 bp, Artificial Sequence
  Description of Artificial Sequence: Synthetic primer
tgtaatggggaaatttgtatgtgag

SEQ ID NO: 325 - DNA, 27 bp, Artificial Sequence
  Description of Artificial Sequence: Synthetic primer
gaatgaaatgtacggcatttatacaca

SEQ ID NO: 326 - DNA, 18 bp, Artificial Sequence
  Description of Artificial Sequence: Synthetic primer
gcttcgctggccttgcta

SEQ ID NO: 327 - DNA, 20 bp, Artificial Sequence
  Description of Artificial Sequence: Synthetic primer
tccccagaatcactgggtgt

SEQ ID NO: 328 - DNA, 23 bp, Artificial Sequence
  Description of Artificial Sequence: Synthetic primer
ggaggatggactgaatctaacca

SEQ ID NO: 329 - DNA, 21 bp, Artificial Sequence
  Description of Artificial Sequence: Synthetic primer
ctggctcttcccagttgacag

SEQ ID NO: 330 - DNA, 27 bp, Artificial Sequence
  Description of Artificial Sequence: Synthetic primer
aaaagacaaacatagtgaatttaagga

SEQ ID NO: 331 - DNA, 26 bp, Artificial Sequence
  Description of Artificial Sequence: Synthetic primer
atttctccctaagttcatatttgatt

SEQ ID NO: 332 - DNA, 24 bp, Artificial Sequence
  Description of Artificial Sequence: Synthetic primer
tagctctgacttggtaaactgtgg

SEQ ID NO: 333 - DNA, 17 bp, Artificial Sequence
  Description of Artificial Sequence: Synthetic primer
gggctggggatgatttg

SEQ ID NO: 334 - DNA, 24 bp, Artificial Sequence
  Description of Artificial Sequence: Synthetic primer
cacccagagtaggggcctgaccta

SEQ ID NO: 335 - DNA, 20 bp, Artificial Sequence
  Description of Artificial Sequence: Synthetic primer
gggagtctcagaacccacag

SEQ ID NO: 336 - DNA, 20 bp, Artificial Sequence
  Description of Artificial Sequence: Synthetic primer
gtgaaatcccaaggtgccta

SEQ ID NO: 337 - DNA, 18 bp, Artificial Sequence
  Description of Artificial Sequence: Synthetic primer
gggtagggcaggcagaga

SEQ ID NO: 338 - DNA, 19 bp, Artificial Sequence
  Description of Artificial Sequence: Synthetic primer
tagctccaccctcaccccg

SEQ ID NO: 339 - DNA, 18 bp, Artificial Sequence
  Description of Artificial Sequence: Synthetic primer
ggtccagctccgactcct

SEQ ID NO: 340 - DNA, 18 bp, Artificial Sequence
  Description of Artificial Sequence: Synthetic primer
tggctgtagcggtcccgt

SEQ ID NO: 341 - DNA, 22 bp, Artificial Sequence
  Description of Artificial Sequence: Synthetic primer
atcctggacgttgcctttactg

SEQ ID NO: 342 - DNA, 22 bp, Artificial Sequence
  Description of Artificial Sequence: Synthetic primer
gatgtttgcatttaccctcctg

SEQ ID NO: 343 - DNA, 22 bp, Artificial Sequence
  Description of Artificial Sequence: Synthetic primer
accagaatttaccctgcctctc

SEQ ID NO: 344 - DNA, 23 bp, Artificial Sequence
  Description of Artificial Sequence: Synthetic primer
gagcaataatgcctttgtgagtc

SEQ ID NO: 345 - DNA, 21 bp, Artificial Sequence
  Description of Artificial Sequence: Synthetic primer
cttggctggagtaagcctgtc

SEQ ID NO: 346 - DNA, 21 bp, Artificial Sequence
  Description of Artificial Sequence: Synthetic primer
gagtgccagtaattgcaaggg

SEQ ID NO: 347 - DNA, 22 bp, Artificial Sequence
  Description of Artificial Sequence: Synthetic primer
ccaaagatctggtaattgagcc

SEQ ID NO: 348 - DNA, 22 bp, Artificial Sequence
  Description of Artificial Sequence: Synthetic primer
gtcaaggagcagacaatgcttc

SEQ ID NO: 349 - DNA, 22 bp, Artificial Sequence
  Description of Artificial Sequence: Synthetic primer
tggagaagtgtgatgtaagccg

SEQ ID NO: 350 - DNA, 22 bp, Artificial Sequence
  Description of Artificial Sequence: Synthetic primer
gatccatttaagagggcctgtg

SEQ ID NO: 351 - DNA, 20 bp, Artificial Sequence
  Description of Artificial Sequence: Synthetic primer
agcacccatggttgaagcag

SEQ ID NO: 352 - DNA, 22 bp, Artificial Sequence
  Description of Artificial Sequence: Synthetic primer
gaatgcccaaccctatcctatg

SEQ ID NO: 353 - DNA, 22 bp, Artificial Sequence
  Description of Artificial Sequence: Synthetic primer
tcttggaaagaatgcgaacatc

SEQ ID NO: 354 - DNA, 24 bp, Artificial Sequence
  Description of Artificial Sequence: Synthetic primer
tccaaaacagcttttgttaacgtc

SEQ ID NO: 355 - DNA, 22 bp, Artificial Sequence
  Description of Artificial Sequence: Synthetic primer
ctgtgagagttctggacacgcc

SEQ ID NO: 356 - DNA, 22 bp, Artificial Sequence
  Description of Artificial Sequence: Synthetic primer
aaagtggctttgtgaacgtcag

SEQ ID NO: 357 - DNA, 22 bp, Artificial Sequence
  Description of Artificial Sequence: Synthetic primer
tgcaccagtatagctctccacc

SEQ ID NO: 358 - DNA, 23 bp, Artificial Sequence
  Description of Artificial Sequence: Synthetic primer
tccagcagctttatgggaatatc

SEQ ID NO: 359 - DNA, 24 bp, Artificial Sequence
  Description of Artificial Sequence: Synthetic primer
cgagattctgtcaacttaacatgg

SEQ ID NO: 360 - DNA, 21 bp, Artificial Sequence
  Description of Artificial Sequence: Synthetic primer
gaactggatgcccgattacac

SEQ ID NO: 361 - DNA, 23 bp, Artificial Sequence
  Description of Artificial Sequence: Synthetic primer
ggtgctgaatacagaccactgtc

SEQ ID NO: 362 - DNA, 21 bp, Artificial Sequence
  Description of Artificial Sequence: Synthetic primer
gtgcgtgtgatgccttgtatc

SEQ ID NO: 363 - DNA, 22 bp, Artificial Sequence
  Description of Artificial Sequence: Synthetic primer
cttctgcttaccaaaaggcttg

SEQ ID NO: 364 - DNA, 24 bp, Artificial Sequence
  Description of Artificial Sequence: Synthetic primer
ttgtttctttctcagatcctccag

SEQ ID NO: 365 - DNA, 24 bp, Artificial Sequence
  Description of Artificial Sequence: Synthetic primer
ttctatgtacattggagcaaatcc

SEQ ID NO: 366 - DNA, 23 bp, Artificial Sequence
  Description of Artificial Sequence: Synthetic primer
tgccgtgtaacatttatttgcag

SEQ ID NO: 367 - DNA, 23 bp, Artificial Sequence
  Description of Artificial Sequence: Synthetic primer
gatgccacagtttaccaagtcag

SEQ ID NO: 368 - DNA, 24 bp, Artificial Sequence
  Description of Artificial Sequence: Synthetic primer
cgaagcttcaagacctataatggc

SEQ ID NO: 369 - DNA, 27 bp, Artificial Sequence
  Description of Artificial Sequence: Synthetic primer
tgcatagaattataatgatggtgtgtg

SEQ ID NO: 370 - DNA, 23 bp, Artificial Sequence
  Description of Artificial Sequence: Synthetic primer
tcagcaatgttggtggtacaaag

SEQ ID NO: 371 - DNA, 22 bp, Artificial Sequence
  Description of Artificial Sequence: Synthetic primer
tcaaggttcttgacagaccagg

SEQ ID NO: 372 - DNA, 22 bp, Artificial Sequence
  Description of Artificial Sequence: Synthetic primer
catgtggcaaccaaacttatcc

SEQ ID NO: 373 - DNA, 22 bp, Artificial Sequence
  Description of Artificial Sequence: Synthetic primer
ggatgccctattcgtctctttg

SEQ ID NO: 374 - DNA, 22 bp, Artificial Sequence
  Description of Artificial Sequence: Synthetic primer
cagcgatcagaccctaaccatc

SEQ ID NO: 375 - DNA, 25 bp, Artificial Sequence
  Description of Artificial Sequence: Synthetic primer
tgtgctcattgaatccctatttacc

SEQ ID NO: 376 - DNA, 22 bp, Artificial Sequence
  Description of Artificial Sequence: Synthetic primer
gttgaagctggtcacaccaaac

SEQ ID NO: 377 - DNA, 22 bp, Artificial Sequence
  Description of Artificial Sequence: Synthetic primer
gctggagttggaaaacctagcc

SEQ ID NO: 378 - DNA, 21 bp, Artificial Sequence
  Description of Artificial Sequence: Synthetic primer
cagaatgctttgttgctcgtg

SEQ ID NO: 379 - DNA, 22 bp, Artificial Sequence
  Description of Artificial Sequence: Synthetic primer
ggcaagccgagtaaagtatcag

SEQ ID NO: 380 - DNA, 22 bp, Artificial Sequence
  Description of Artificial Sequence: Synthetic primer
ttgcaaggatgaatacggtagg

SEQ ID NO: 381 - DNA, 24 bp, Artificial Sequence
  Description of Artificial Sequence: Synthetic primer
agcaactcttaatctcaagcacag

SEQ ID NO: 382 - DNA, 27 bp, Artificial Sequence
  Description of Artificial Sequence: Synthetic primer
caaaagtggaactgagaaagtattagg

SEQ ID NO: 383 - DNA, 22 bp, Artificial Sequence
  Description of Artificial Sequence: Synthetic primer
cacagaatgatgttggcctgag

SEQ ID NO: 384 - DNA, 21 bp, Artificial Sequence
  Description of Artificial Sequence: Synthetic primer
accctcactgtggaaaactgc

SEQ ID NO: 385 - DNA, 22 bp, Artificial Sequence
  Description of Artificial Sequence: Synthetic primer
gttgcaagaaccatgatgaaag

SEQ ID NO: 386 - DNA, 22 bp, Artificial Sequence
  Description of Artificial Sequence: Synthetic primer
tcgttttagaaaagcctggacc

SEQ ID NO: 387 - DNA, 22 bp, Artificial Sequence
  Description of Artificial Sequence: Synthetic primer
tatcgttcttgacaaaccaggg

SEQ ID NO: 388 - DNA, 22 bp, Artificial Sequence
  Description of Artificial Sequence: Synthetic primer
tggcaccaaggaaggaactatc

SEQ ID NO: 389 - DNA, 21 bp, Artificial Sequence
  Description of Artificial Sequence: Synthetic primer
agcctggtcctgtgagaaatc

SEQ ID NO: 390 - DNA, 21 bp, Artificial Sequence
  Description of Artificial Sequence: Synthetic primer
caccaagtgaccaccacaaag

SEQ ID NO: 391 - DNA, 22 bp, Artificial Sequence
  Description of Artificial Sequence: Synthetic primer
ggtggtaaaaggcctcaaagag

SEQ ID NO: 392 - DNA, 22 bp, Artificial Sequence
  Description of Artificial Sequence: Synthetic primer
gaaaatgctgcaggagttggac

SEQ ID NO: 393 - DNA, 20 bp, Artificial Sequence
  Description of Artificial Sequence: Synthetic primer
tggttcagaagcaaaatggg

SEQ ID NO: 394 - DNA, 22 bp, Artificial Sequence
  Description of Artificial Sequence: Synthetic primer
tgaaagctgctgaacctccttc

SEQ ID NO: 395 - DNA, 22 bp, Artificial Sequence
  Description of Artificial Sequence: Synthetic primer
aagcatcagaacgacctcttcc

SEQ ID NO: 396 - DNA, 27 bp, Artificial Sequence
  Description of Artificial Sequence: Synthetic primer
gaatataccttcagagtgagtgctgag

SEQ ID NO: 397 - DNA, 20 bp, Artificial Sequence
  Description of Artificial Sequence: Synthetic primer
taaagtggcggaggcctgac

SEQ ID NO: 398 - DNA, 22 bp, Artificial Sequence
  Description of Artificial Sequence: Synthetic primer
agtcctcaccctggaaattctg

SEQ ID NO: 399 - DNA, 22 bp, Artificial Sequence
  Description of Artificial Sequence: Synthetic primer
ggtggcacagctaattttcaac

SEQ ID NO: 400 - DNA, 22 bp, Artificial Sequence
  Description of Artificial Sequence: Synthetic primer
ttgtgctcccataacccactac

SEQ ID NO: 401 - DNA, 22 bp, Artificial Sequence
  Description of Artificial Sequence: Synthetic primer
cccagtgatagctctgaccctc

SEQ ID NO: 402 - DNA, 22 bp, Artificial Sequence
  Description of Artificial Sequence: Synthetic primer
gtgaggctacatcagttcctgg

SEQ ID NO: 403 - DNA, 22 bp, Artificial Sequence
  Description of Artificial Sequence: Synthetic primer
tggaactccaaaggctgaagac

SEQ ID NO: 404 - DNA, 20 bp, Artificial Sequence
  Description of Artificial Sequence: Synthetic primer
cccattattgatggcggaag

SEQ ID NO: 405 - DNA, 23 bp, Artificial Sequence
  Description of Artificial Sequence: Synthetic primer
ggcagacctgaaccagacataac

SEQ ID NO: 406 - DNA, 22 bp, Artificial Sequence
  Description of Artificial Sequence: Synthetic primer
aaatcaaggcgacaaagagaag

SEQ ID NO: 407 - DNA, 22 bp, Artificial Sequence
  Description of Artificial Sequence: Synthetic primer
acaatgcctcagaagaccatcc

SEQ ID NO: 408 - DNA, 22 bp, Artificial Sequence
  Description of Artificial Sequence: Synthetic primer
tccatggatgattaagacctgg

SEQ ID NO: 409 - DNA, 24 bp, Artificial Sequence
  Description of Artificial Sequence: Synthetic primer
ggcactagatccatttacagttcc

SEQ ID NO: 410 - DNA, 22 bp, Artificial Sequence
  Description of Artificial Sequence: Synthetic primer
aatccatttgtgcttcctggac

SEQ ID NO: 411 - DNA, 22 bp, Artificial Sequence
  Description of Artificial Sequence: Synthetic primer
ttgcagtgaatccttatggacc

SEQ ID NO: 412 - DNA, 22 bp, Artificial Sequence
  Description of Artificial Sequence: Synthetic primer
attttaggagtgacaaggccag

SEQ ID NO: 413 - DNA, 22 bp, Artificial Sequence
  Description of Artificial Sequence: Synthetic primer
ggaacgtcgagaagtaactggc

SEQ ID NO: 414 - DNA, 24 bp, Artificial Sequence
  Description of Artificial Sequence: Synthetic primer
aaatggcgtattcctaaactgtcc

SEQ ID NO: 415 - DNA, 22 bp, Artificial Sequence
  Description of Artificial Sequence: Synthetic primer
tatggcattggagaaccttgtg

SEQ ID NO: 416 - DNA, 21 bp, Artificial Sequence
  Description of Artificial Sequence: Synthetic primer
aaaggtgaacagacgtggtcc

SEQ ID NO: 417 - DNA, 27 bp, Artificial Sequence
  Description of Artificial Sequence: Synthetic primer
ccactgggcctattatagttaaagatg

SEQ ID NO: 418 - DNA, 22 bp, Artificial Sequence
  Description of Artificial Sequence: Synthetic primer
aggatgaggttgaactcccaag

SEQ ID NO: 419 - DNA, 22 bp, Artificial Sequence
  Description of Artificial Sequence: Synthetic primer
gctatcacttgcagggatgatg

SEQ ID NO: 420 - DNA, 22 bp, Artificial Sequence
  Description of Artificial Sequence: Synthetic primer
ctcacccatcactggctatttg

SEQ ID NO: 421 - DNA, 25 bp, Artificial Sequence
  Description of Artificial Sequence: Synthetic primer
tgagcactacacagttgaaacagac

SEQ ID NO: 422 - DNA, 22 bp, Artificial Sequence
  Description of Artificial Sequence: Synthetic primer
gagtcacagccactaacacagc

SEQ ID NO: 423 - DNA, 22 bp, Artificial Sequence
  Description of Artificial Sequence: Synthetic primer
aagaccacctcctgtcataacg

SEQ ID NO: 424 - DNA, 22 bp, Artificial Sequence
  Description of Artificial Sequence: Synthetic primer
caccattcctcaagttactcgc

SEQ ID NO: 425 - DNA, 23 bp, Artificial Sequence
  Description of Artificial Sequence: Synthetic primer
tcagctgttgttgcagagtatcc

SEQ ID NO: 426 - DNA, 21 bp, Artificial Sequence
  Description of Artificial Sequence: Synthetic primer
ctacaaagaaccaggccctcc

SEQ ID NO: 427 - DNA, 24 bp, Artificial Sequence
  Description of Artificial Sequence: Synthetic primer
tgccaactatccatttaaggttcc

SEQ ID NO: 428 - DNA, 23 bp, Artificial Sequence
  Description of Artificial Sequence: Synthetic primer
gaagcagcatatgaatttcccac

SEQ ID NO: 429 - DNA, 22 bp, Artificial Sequence
  Description of Artificial Sequence: Synthetic primer
ttggatcctctccgtaagttgc

SEQ ID NO: 430 - DNA, 27 bp, Artificial Sequence
  Description of Artificial Sequence: Synthetic primer
tgaagatggtggaatttattctttaac

SEQ ID NO: 431 - DNA, 22 bp, Artificial Sequence
  Description of Artificial Sequence: Synthetic primer
ccacaaatcatgtcagaggagc

SEQ ID NO: 432 - DNA, 26 bp, Artificial Sequence
  Description of Artificial Sequence: Synthetic primer
cactgcaaactcattaacttttcttc

SEQ ID NO: 433 - DNA, 21 bp, Artificial Sequence
  Description of Artificial Sequence: Synthetic primer
aggaacccaggaaatcacagg

SEQ ID NO: 434 - DNA, 23 bp, Artificial Sequence
  Description of Artificial Sequence: Synthetic primer
caaagcttggttttgattcttgg

SEQ ID NO: 435 - DNA, 24 bp, Artificial Sequence
  Description of Artificial Sequence: Synthetic primer
gtgatcacagaatatttgcctttc

SEQ ID NO: 436 - DNA, 27 bp, Artificial Sequence
  Description of Artificial Sequence: Synthetic primer
cctgaaagcattttagttacttacacc

SEQ ID NO: 437 - DNA, 23 bp, Artificial Sequence
  Description of Artificial Sequence: Synthetic primer
ttatcactagtttgattcccggc

SEQ ID NO: 438 - DNA, 22 bp, Artificial Sequence
  Description of Artificial Sequence: Synthetic primer
tgaaagccaaagatcgtttcag

SEQ ID NO: 439 - DNA, 22 bp, Artificial Sequence
  Description of Artificial Sequence: Synthetic primer
gagttgccactttcccattttg

SEQ ID NO: 440 - DNA, 25 bp, Artificial Sequence
  Description of Artificial Sequence: Synthetic primer
ttttagaaacccagactgtgcctac

SEQ ID NO: 441 - DNA, 22 bp, Artificial Sequence
  Description of Artificial Sequence: Synthetic primer
gaggggttgcttggttgtgtag

SEQ ID NO: 442 - DNA, 25 bp, Artificial Sequence
  Description of Artificial Sequence: Synthetic primer
tgcatcaatgtgaaatttgtatgag

SEQ ID NO: 443 - DNA, 22 bp, Artificial Sequence
  Description of Artificial Sequence: Synthetic primer
agtggtgccagtgataccagtc

SEQ ID NO: 444 - DNA, 23 bp, Artificial Sequence
  Description of Artificial Sequence: Synthetic primer
ttctgccattagatatgcctgac

SEQ ID NO: 445 - DNA, 24 bp, Artificial Sequence
  Description of Artificial Sequence: Synthetic primer
tctctctgatggagtggaagattg

SEQ ID NO: 446 - DNA, 26 bp, Artificial Sequence
  Description of Artificial Sequence: Synthetic primer
caaagctatgctgtatgctgtgtaac

SEQ ID NO: 447 - DNA, 25 bp, Artificial Sequence
  Description of Artificial Sequence: Synthetic primer
ttttgttttaagaaggtggttttcc

SEQ ID NO: 448 - DNA, 25 bp, Artificial Sequence
  Description of Artificial Sequence: Synthetic primer
gcataataacatgatgtagcttggc

SEQ ID NO: 449 - DNA, 22 bp, Artificial Sequence
  Description of Artificial Sequence: Synthetic primer
gacaaaactgcagtggagaagg

SEQ ID NO: 450 - DNA, 22 bp, Artificial Sequence
  Description of Artificial Sequence: Synthetic primer
actttggacccacagaatttgg

SEQ ID NO: 451 - DNA, 22 bp, Artificial Sequence
  Description of Artificial Sequence: Synthetic primer
tgaagctcagaatcctttccac

SEQ ID NO: 452 - DNA, 22 bp, Artificial Sequence
  Description of Artificial Sequence: Synthetic primer
cccagacgatgaaggtgatttc

SEQ ID NO: 453 - DNA, 26 bp, Artificial Sequence
  Description of Artificial Sequence: Synthetic primer
catttaactcttcttccttgaactgc

SEQ ID NO: 454 - DNA, 22 bp, Artificial Sequence
  Description of Artificial Sequence: Synthetic primer
ggaagccattaaagcaagaagc

SEQ ID NO: 455 - DNA, 22 bp, Artificial Sequence
  Description of Artificial Sequence: Synthetic primer
agccccacttagagacaagtgc

SEQ ID NO: 456 - DNA, 25 bp, Artificial Sequence
  Description of Artificial Sequence: Synthetic primer
ttgcaagctaactgataatccaatg

SEQ ID NO: 457 - DNA, 22 bp, Artificial Sequence
  Description of Artificial Sequence: Synthetic primer
aatgggtcccttttactcaggc

SEQ ID NO: 458 - DNA, 26 bp, Artificial Sequence
  Description of Artificial Sequence: Synthetic primer
caaagaagtcagtgcaaatgagatag

SEQ ID NO: 459 - DNA, 22 bp, Artificial Sequence
  Description of Artificial Sequence: Synthetic primer
aagtgctgaagaaagctgtccc

SEQ ID NO: 460 - DNA, 24 bp, Artificial Sequence
  Description of Artificial Sequence: Synthetic primer
gctacattcgaccagcatgaatac

SEQ ID NO: 461 - DNA, 22 bp, Artificial Sequence
  Description of Artificial Sequence: Synthetic primer
gtgtcttggtacaaggatgggg

SEQ ID NO: 462 - DNA, 22 bp, Artificial Sequence
  Description of Artificial Sequence: Synthetic primer
agagccagaatatgatggaggc

SEQ ID NO: 463 - DNA, 22 bp, Artificial Sequence
  Description of Artificial Sequence: Synthetic primer
gatgctgggagaaaacacattg

SEQ ID NO: 464 - DNA, 23 bp, Artificial Sequence
  Description of Artificial Sequence: Synthetic primer
gaagaccttaggattgttgagcc

SEQ ID NO: 465 - DNA, 22 bp, Artificial Sequence
  Description of Artificial Sequence: Synthetic primer
aagacctccacggctaaacttg

SEQ ID NO: 466 - DNA, 22 bp, Artificial Sequence
  Description of Artificial Sequence: Synthetic primer
gtggaacaaagggaggatggag

SEQ ID NO: 467 - DNA, 23 bp, Artificial Sequence
  Description of Artificial Sequence: Synthetic primer
tgtctttgtccttgaattgtttg

SEQ ID NO: 468 - DNA, 25 bp, Artificial Sequence
  Description of Artificial Sequence: Synthetic primer
caacttaaagaccagggcaattatc

SEQ ID NO: 469 - DNA, 22 bp, Artificial Sequence
  Description of Artificial Sequence: Synthetic primer
gcctgatagaaaatgaggctgg

SEQ ID NO: 470 - DNA, 22 bp, Artificial Sequence
  Description of Artificial Sequence: Synthetic primer
tctgcctacagtggatccaaac

SEQ ID NO: 471 - DNA, 22 bp, Artificial Sequence
  Description of Artificial Sequence: Synthetic primer
tattttcagccactcctggacc

SEQ ID NO: 472 - DNA, 22 bp, Artificial Sequence
  Description of Artificial Sequence: Synthetic primer
cggaagagaatcctggtcattc

SEQ ID NO: 473 - DNA, 22 bp, Artificial Sequence
  Description of Artificial Sequence: Synthetic primer
tgctttacggctggttttatcc

SEQ ID NO: 474 - DNA, 22 bp, Artificial Sequence
  Description of Artificial Sequence: Synthetic primer
ccaagaaagtcaagtcccacac

SEQ ID NO: 475 - DNA, 22 bp, Artificial Sequence
  Description of Artificial Sequence: Synthetic primer
aaaagtgaatgctaagccccac

SEQ ID NO: 476 - DNA, 22 bp, Artificial Sequence
  Description of Artificial Sequence: Synthetic primer
acctaaccagcatccagaatgg

SEQ ID NO: 477 - DNA, 22 bp, Artificial Sequence
  Description of Artificial Sequence: Synthetic primer
gaatgagcctcacattcaccag

SEQ ID NO: 478 - DNA, 22 bp, Artificial Sequence
  Description of Artificial Sequence: Synthetic primer
ggaatttgatggaaaggcaaag

SEQ ID NO: 479 - DNA, 25 bp, Artificial Sequence
  Description of Artificial Sequence: Synthetic primer
ttctaatatctgcctgtgagctacg

SEQ ID NO: 480 - DNA, 23 bp, Artificial Sequence
  Description of Artificial Sequence: Synthetic primer
ggcagcttcaagtgatttcaaag

SEQ ID NO: 481 - DNA, 24 bp, Artificial Sequence
  Description of Artificial Sequence: Synthetic primer
tttataatggagcatgactcaccc

SEQ ID NO: 482 - DNA, 26 bp, Artificial Sequence
  Description of Artificial Sequence: Synthetic primer
tgtttatatctctcatgctctgcttg

SEQ ID NO: 483 - DNA, 23 bp, Artificial Sequence
  Description of Artificial Sequence: Synthetic primer
ccatgaagctatgtcctaagcag

SEQ ID NO: 484 - DNA, 26 bp, Artificial Sequence
  Description of Artificial Sequence: Synthetic primer
ttgtctttagagaggaataaaccagg

SEQ ID NO: 485 - DNA, 22 bp, Artificial Sequence
  Description of Artificial Sequence: Synthetic primer
gcactgtatccgtccatgtttc

SEQ ID NO: 486 - DNA, 22 bp, Artificial Sequence
  Description of Artificial Sequence: Synthetic primer
aagactccagcacttcatcagc

SEQ ID NO: 487 - DNA, 27 bp, Artificial Sequence
  Description of Artificial Sequence: Synthetic primer
aaaataaacataggcttcttctgcttc

SEQ ID NO: 488 - DNA, 22 bp, Artificial Sequence
  Description of Artificial Sequence: Synthetic primer
gtttgattaaccagaaggcagg

SEQ ID NO: 489 - DNA, 24 bp, Artificial Sequence
  Description of Artificial Sequence: Synthetic primer
cgtgggcttaattttagttttgac

SEQ ID NO: 490 - DNA, 26 bp, Artificial Sequence
  Description of Artificial Sequence: Synthetic primer
atgtgtaatatgaaggaatgtgtgtg

SEQ ID NO: 491 - DNA, 22 bp, Artificial Sequence
  Description of Artificial Sequence: Synthetic primer
ggtgtactgtgcaactcttccc

SEQ ID NO: 492 - DNA, 21 bp, Artificial Sequence
  Description of Artificial Sequence: Synthetic primer
cccatttcggttacctggaag

SEQ ID NO: 493 - DNA, 22 bp, Artificial Sequence
  Description of Artificial Sequence: Synthetic primer
tgataacattgcaaccctccag

SEQ ID NO: 494 - DNA, 22 bp, Artificial Sequence
  Description of Artificial Sequence: Synthetic primer
gagctggataaagaccgtgttg

SEQ ID NO: 495 - DNA, 25 bp, Artificial Sequence
  Description of Artificial Sequence: Synthetic primer
ttgaaaatgtccctaagaaatccac

SEQ ID NO: 496 - DNA, 22 bp, Artificial Sequence
  Description of Artificial Sequence: Synthetic primer
gaacccttaaagaccacttccc

SEQ ID NO: 497 - DNA, 23 bp, Artificial Sequence
  Description of Artificial Sequence: Synthetic primer
gggagtggaagataagtggatgg

SEQ ID NO: 498 - DNA, 23 bp, Artificial Sequence
  Description of Artificial Sequence: Synthetic primer
cacctctagggttcctactccac

SEQ ID NO: 499 - DNA, 23 bp, Artificial Sequence
  Description of Artificial Sequence: Synthetic primer
gatttgtgcatgtgcctatgttc

SEQ ID NO: 500 - DNA, 22 bp, Artificial Sequence
  Description of Artificial Sequence: Synthetic primer
tcccatggatgttttaactggg

SEQ ID NO: 501 - DNA, 24 bp, Artificial Sequence
  Description of Artificial Sequence: Synthetic primer
tttcttgtgtcagcatgtattgtc

SEQ ID NO: 502 - DNA, 22 bp, Artificial Sequence
  Description of Artificial Sequence: Synthetic primer
ggggaaattgttggctattttg

SEQ ID NO: 503 - DNA, 22 bp, Artificial Sequence
  Description of Artificial Sequence: Synthetic primer
ctgctgaatgtactgcctgctc

SEQ ID NO: 504 - DNA, 24 bp, Artificial Sequence
  Description of Artificial Sequence: Synthetic primer
gtttcatcaccatttatttgttgc

SEQ ID NO: 505 - DNA, 24 bp, Artificial Sequence
  Description of Artificial Sequence: Synthetic primer
tcggtgtaaatgcttactttccag

SEQ ID NO: 506 - DNA, 21 bp, Artificial Sequence
  Description of Artificial Sequence: Synthetic primer
tttacacaagcgtttcgaagg

SEQ ID NO: 507 - DNA, 22 bp, Artificial Sequence
  Description of Artificial Sequence: Synthetic primer
ctgcttgatcctgcttcaaatc

SEQ ID NO: 508 - DNA, 23 bp, Artificial Sequence
  Description of Artificial Sequence: Synthetic primer
aaaagagccaaatggatctaggg

SEQ ID NO: 509 - DNA, 22 bp, Artificial Sequence
  Description of Artificial Sequence: Synthetic primer
attaaatggctctgcacccatc

SEQ ID NO: 510 - DNA, 21 bp, Artificial Sequence
  Description of Artificial Sequence: Synthetic primer
atgcaccagataagcccattg

SEQ ID NO: 511 - DNA, 21 bp, Artificial Sequence
  Description of Artificial Sequence: Synthetic primer
ctgcagtttgtatccctggtc

SEQ ID NO: 512 - DNA, 22 bp, Artificial Sequence
  Description of Artificial Sequence: Synthetic primer
ttccaagagattgtcatttccc

SEQ ID NO: 513 - DNA, 24 bp, Artificial Sequence
  Description of Artificial Sequence: Synthetic primer
tgcagcgaaaattgttacttaatg

SEQ ID NO: 514 - DNA, 22 bp, Artificial Sequence
  Description of Artificial Sequence: Synthetic primer
acagacctgtcttgagcgactg

SEQ ID NO: 515 - DNA, 22 bp, Artificial Sequence
  Description of Artificial Sequence: Synthetic primer
ggaagggctggtgtatgagtag

SEQ ID NO: 516 - DNA, 23 bp, Artificial Sequence
  Description of Artificial Sequence: Synthetic primer
cagatacaaggcacacactcacc

SEQ ID NO: 517 - DNA, 23 bp, Artificial Sequence
  Description of Artificial Sequence: Synthetic primer
ttccttagaaccgccttattttg

SEQ ID NO: 518 - DNA, 22 bp, Artificial Sequence
  Description of Artificial Sequence: Synthetic primer
agtggggaatacacctgtgtgg

SEQ ID NO: 519 - DNA, 22 bp, Artificial Sequence
  Description of Artificial Sequence: Synthetic primer
ttgcccagctcaaattttattc

SEQ ID NO: 520 - DNA, 23 bp, Artificial Sequence
  Description of Artificial Sequence: Synthetic primer
aatcacttcaatggaggtggaag

SEQ ID NO: 521 - DNA, 22 bp, Artificial Sequence
  Description of Artificial Sequence: Synthetic primer
aaggaaccagatactgcatggc

SEQ ID NO: 522 - DNA, 21 bp, Artificial Sequence
  Description of Artificial Sequence: Synthetic primer
gattctggggaatggactgtg

SEQ ID NO: 523 - DNA, 20 bp, Artificial Sequence
  Description of Artificial Sequence: Synthetic primer
ctgcaaagcagctccagagt

SEQ ID NO: 524 - DNA, 25 bp, Artificial Sequence
  Description of Artificial Sequence: Synthetic primer
cagggatgataatgtgaaatatgga

SEQ ID NO: 525 - DNA, 27 bp, Artificial Sequence
  Description of Artificial Sequence: Synthetic primer
cacaagtgcttttgaacttaatgaaag

SEQ ID NO: 526 - DNA, 23 bp, Artificial Sequence
  Description of Artificial Sequence: Synthetic primer
tcatcacctatttcagttgcctg

SEQ ID NO: 527 - DNA, 22 bp, Artificial Sequence
  Description of Artificial Sequence: Synthetic primer
tcatgtgaagcagtgaatgacg

SEQ ID NO: 528 - DNA, 22 bp, Artificial Sequence
  Description of Artificial Sequence: Synthetic primer
ttgtcctctagaaaatggaggc

SEQ ID NO: 529 - DNA, 22 bp, Artificial Sequence
  Description of Artificial Sequence: Synthetic primer
aaggacaaggcagtaggagtgg

SEQ ID NO: 530 - DNA, 24 bp, Artificial Sequence
  Description of Artificial Sequence: Synthetic primer
tcatagctccttgccacagtaaag

SEQ ID NO: 531 - DNA, 24 bp, Artificial Sequence
  Description of Artificial Sequence: Synthetic primer
tgtataaataatttgggcaacaca

SEQ ID NO: 532 - DNA, 26 bp, Artificial Sequence
  Description of Artificial Sequence: Synthetic primer
gcaaaagaataaaatcaaagcacatt

SEQ ID NO: 533 - DNA, 23 bp, Artificial Sequence
  Description of Artificial Sequence: Synthetic primer
tcaaggtaggaaggcaaagagtg

SEQ ID NO: 534 - DNA, 23 bp, Artificial Sequence
  Description of Artificial Sequence: Synthetic primer
ccatctcactgggagaaacaatc

SEQ ID NO: 535 - DNA, 22 bp, Artificial Sequence
  Description of Artificial Sequence: Synthetic primer
tgtgtgttgggtctctttgttg

SEQ ID NO: 536 - DNA, 25 bp, Artificial Sequence
  Description of Artificial Sequence: Synthetic primer
cctgcaatttctaaaagagctgaac

SEQ ID NO: 537 - DNA, 22 bp, Artificial Sequence
  Description of Artificial Sequence: Synthetic primer
ctacatgctcccttctgtgagg

SEQ ID NO: 538 - DNA, 25 bp, Artificial Sequence
  Description of Artificial Sequence: Synthetic primer
aaagttgagaaggtaccaaaactct

SEQ ID NO: 539 - DNA, 27 bp, Artificial Sequence
  Description of Artificial Sequence: Synthetic primer
cattgaatattgtgcttaaagagagaa

SEQ ID NO: 540 - DNA, 27 bp, Artificial Sequence
  Description of Artificial Sequence: Synthetic primer
catgagctaagagtttatgagatttcc

SEQ ID NO: 541 - DNA, 19 bp, Artificial Sequence
  Description of Artificial Sequence: Synthetic primer
gggctagccatcggaggat

SEQ ID NO: 542 - DNA, 25 bp, Artificial Sequence
  Description of Artificial Sequence: Synthetic primer
gtgctggactctacttacccattag

SEQ ID NO: 543 - DNA, 26 bp, Artificial Sequence
  Description of Artificial Sequence: Synthetic primer
cttaactcatcttttctctgtcttgg

SEQ ID NO: 544 - DNA, 24 bp, Artificial Sequence
  Description of Artificial Sequence: Synthetic primer
ccaagcagagggtactgtttatcc

SEQ ID NO: 545 - DNA, 22 bp, Artificial Sequence
  Description of Artificial Sequence: Synthetic primer
gagttttgcatgctctcttgtg

SEQ ID NO: 546 - DNA, 19 bp, Artificial Sequence
  Description of Artificial Sequence: Synthetic primer
ggtggctcagttttccagt

SEQ ID NO: 547 - DNA, 23 bp, Artificial Sequence
  Description of Artificial Sequence: Synthetic primer
attgccagccttaaaatcttagc

SEQ ID NO: 548 - DNA, 27 bp, Artificial Sequence
  Description of Artificial Sequence: Synthetic primer
tgtaatcttagatgtctcagaaggtga

SEQ ID NO: 549 - DNA, 24 bp, Artificial Sequence
  Description of Artificial Sequence: Synthetic primer
acctgaagataatggaggaggaga

SEQ ID NO: 550 - DNA, 23 bp, Artificial Sequence
  Description of Artificial Sequence: Synthetic primer
tttctgtctgactgtgtctttgg

SEQ ID NO: 551 - DNA, 24 bp, Artificial Sequence
  Description of Artificial Sequence: Synthetic primer
caccaatttcaactgttttactcc

SEQ ID NO: 552 - DNA, 22 bp, Artificial Sequence
  Description of Artificial Sequence: Synthetic primer
agagaaggggattccatcattc

SEQ ID NO: 553 - DNA, 24 bp, Artificial Sequence
  Description of Artificial Sequence: Synthetic primer
caggacttcttttccttgatgatg

SEQ ID NO: 554 - DNA, 26 bp, Artificial Sequence
  Description of Artificial Sequence: Synthetic primer
aatgtccataaaactgtcacaataat

SEQ ID NO: 555 - DNA, 23 bp, Artificial Sequence
  Description of Artificial Sequence: Synthetic primer
tagatgctctttcagggagaact

SEQ ID NO: 556 - DNA, 21 bp, Artificial Sequence
  Description of Artificial Sequence: Synthetic primer
gggaggaaaccagagcttcaa

SEQ ID NO: 557 - DNA, 25 bp, Artificial Sequence
  Description of Artificial Sequence: Synthetic primer
tcatttcatgtttgtctctgttttc

SEQ ID NO: 558 - DNA, 22 bp, Artificial Sequence
  Description of Artificial Sequence: Synthetic primer
atgaccttggaatgtgttgtgg

SEQ ID NO: 559 - DNA, 23 bp, Artificial Sequence
  Description of Artificial Sequence: Synthetic primer
aacaagtttgcaagaagaaatgg

SEQ ID NO: 560 - DNA, 21 bp, Artificial Sequence
  Description of Artificial Sequence: Synthetic primer
acatgccaatcccacgtaatc

SEQ ID NO: 561 - DNA, 22 bp, Artificial Sequence
  Description of Artificial Sequence: Synthetic primer
gagggtgacattgttcagcttg

SEQ ID NO: 562 - DNA, 26 bp, Artificial Sequence
  Description of Artificial Sequence: Synthetic primer
gatttttgttgtagagtaaggcaaac

SEQ ID NO: 563 - DNA, 25 bp, Artificial Sequence
  Description of Artificial Sequence: Synthetic primer
tgtcaagtgtttatgtttgggctac

SEQ ID NO: 564 - DNA, 24 bp, Artificial Sequence
  Description of Artificial Sequence: Synthetic primer
aaatgcacccatatactagattgc

SEQ ID NO: 565 - DNA, 27 bp, Artificial Sequence
  Description of Artificial Sequence: Synthetic primer
attagtagtttgctaacttcactatgc

SEQ ID NO: 566 - DNA, 23 bp, Artificial Sequence
  Description of Artificial Sequence: Synthetic primer
ttgccctgaaaggtcagttatac

SEQ ID NO: 567 - DNA, 21 bp, Artificial Sequence
  Description of Artificial Sequence: Synthetic primer
agaattgaggaaggcaagtcc

SEQ ID NO: 568 - DNA, 22 bp, Artificial Sequence
  Description of Artificial Sequence: Synthetic primer
agccaagaagcactggtaaagg

SEQ ID NO: 569 - DNA, 27 bp, Artificial Sequence
  Description of Artificial Sequence: Synthetic primer
ggggagataaaagacatacaagacatc

SEQ ID NO: 570 - DNA, 23 bp, Artificial Sequence
  Description of Artificial Sequence: Synthetic primer
acaacaacatatgccttgtcaaa

SEQ ID NO: 571 - DNA, 23 bp, Artificial Sequence
  Description of Artificial Sequence: Synthetic primer
tgaccttatcaagagatggtgtc

SEQ ID NO: 572 - DNA, 26 bp, Artificial Sequence
  Description of Artificial Sequence: Synthetic primer
aaatatcactttggttcagctcattt

SEQ ID NO: 573 - DNA, 29 bp, Artificial Sequence
  Description of Artificial Sequence: Synthetic primer
ttgaatgatgatagacaattaaaaataag

SEQ ID NO: 574 - DNA, 22 bp, Artificial Sequence
  Description of Artificial Sequence: Synthetic primer
aagcccagtccagtcttagtgc

SEQ ID NO: 575 - DNA, 22 bp, Artificial Sequence
  Description of Artificial Sequence: Synthetic primer
gggaatttctttgcatcaatgg

SEQ ID NO: 576 - DNA, 22 bp, Artificial Sequence
  Description of Artificial Sequence: Synthetic primer
gaggctttagttgaaaggggag

SEQ ID NO: 577 - DNA, 24 bp, Artificial Sequence
  Description of Artificial Sequence: Synthetic primer
tggtcataagagatgtgactgctg

SEQ ID NO: 578 - DNA, 24 bp, Artificial Sequence
  Description of Artificial Sequence: Synthetic primer
cagacttaccataccaatcaaagg

SEQ ID NO: 579 - DNA, 19 bp, Artificial Sequence
  Description of Artificial Sequence: Synthetic primer
gcagctgcaaggctagaat

SEQ ID NO: 580 - DNA, 21 bp, Artificial Sequence
  Description of Artificial Sequence: Synthetic primer
gcagtgaacatgatgggacag

SEQ ID NO: 581 - DNA, 26 bp, Artificial Sequence
  Description of Artificial Sequence: Synthetic primer
aatcaaatatgaacttagggagaaat

SEQ ID NO: 582 - DNA, 21 bp, Artificial Sequence
  Description of Artificial Sequence: Synthetic primer
gttggttccagtgagggactg

SEQ ID NO: 583 - DNA, 20 bp, Artificial Sequence
  Description of Artificial Sequence: Synthetic primer
aattcgctgtgctcaagggc

SEQ ID NO: 584 - DNA, 22 bp, Artificial Sequence
  Description of Artificial Sequence: Synthetic primer
caggataccacgtggactgaag

SEQ ID NO: 585 - DNA, 23 bp, Artificial Sequence
  Description of Artificial Sequence: Synthetic primer
tgttgacaccactgaaaccaaag

SEQ ID NO: 586 - DNA, 28 bp, Artificial Sequence
  Description of Artificial Sequence: Synthetic primer
tctaaaatcacagtactttctggctagt

SEQ ID NO: 587 - DNA, 29 bp, Artificial Sequence
  Description of Artificial Sequence: Synthetic primer
tctaaatacttgagtataaaatccatgtg

SEQ ID NO: 588 - DNA, 23 bp, Artificial Sequence
  Description of Artificial Sequence: Synthetic primer
cgaggctggtcttgaactaattt

SEQ ID NO: 589 - DNA, 25 bp, Artificial Sequence
  Description of Artificial Sequence: Synthetic primer
atgggatcttcagctacaaaaacaa

SEQ ID NO: 590 - DNA, 24 bp, Artificial Sequence
  Description of Artificial Sequence: Synthetic primer
gagaaattaaggagagcagcaaac

SEQ ID NO: 591 - DNA, 23 bp, Artificial Sequence
  Description of Artificial Sequence: Synthetic primer
tcaagaaattgtcctggaagttg

SEQ ID NO: 592 - DNA, 22 bp, Artificial Sequence
  Description of Artificial Sequence: Synthetic primer
gaatgtcaaacccctggaagtc

SEQ ID NO: 593 - DNA, 25 bp, Artificial Sequence
  Description of Artificial Sequence: Synthetic primer
tgagaaaagtcttgtggaagaatcc

SEQ ID NO: 594 - DNA, 21 bp, Artificial Sequence
  Description of Artificial Sequence: Synthetic primer
gtttgtggtcttatcctcacg

SEQ ID NO: 595 - DNA, 25 bp, Artificial Sequence
  Description of Artificial Sequence: Synthetic primer
catcctgtattttcctgagtgtttc

SEQ ID NO: 596 - DNA, 23 bp, Artificial Sequence
  Description of Artificial Sequence: Synthetic primer
cctggttcaaagatgaagctgat

SEQ ID NO: 597 - DNA, 24 bp, Artificial Sequence
  Description of Artificial Sequence: Synthetic primer
catgatctggacaatcttttcaac

SEQ ID NO: 598 - DNA, 24 bp, Artificial Sequence
  Description of Artificial Sequence: Synthetic primer
tcatcttcccttagatcaaccctc

SEQ ID NO: 599 - DNA, 21 bp, Artificial Sequence
  Description of Artificial Sequence: Synthetic primer
tcctactggaggaccaaaccc

SEQ ID NO: 600 - DNA, 22 bp, Artificial Sequence
  Description of Artificial Sequence: Synthetic primer
ctcaaagttccatccacacagc

SEQ ID NO: 601 - DNA, 22 bp, Artificial Sequence
  Description of Artificial Sequence: Synthetic primer
tctgcctggtatactgcgactg

SEQ ID NO: 602 - DNA, 24 bp, Artificial Sequence
  Description of Artificial Sequence: Synthetic primer
agttggttagccttgatttttaac

SEQ ID NO: 603 - DNA, 23 bp, Artificial Sequence
  Description of Artificial Sequence: Synthetic primer
cctcaacagacgcactaaaaaca

SEQ ID NO: 604 - DNA, 19 bp, Artificial Sequence
  Description of Artificial Sequence: Synthetic primer
catctgcctgtcctgatgc

SEQ ID NO: 605 - DNA, 30 bp, Artificial Sequence
  Description of Artificial Sequence: Synthetic primer
aaaactcttaaatatagatggtgttgaaag

SEQ ID NO: 606 - DNA, 20 bp, Artificial Sequence
  Description of Artificial Sequence: Synthetic primer
taaacagagcatggtgttgc

SEQ ID NO: 607 - DNA, 22 bp, Artificial Sequence
  Description of Artificial Sequence: Synthetic primer
ggaagggggaagggtcatacta

SEQ ID NO: 608 - DNA, 26 bp, Artificial Sequence
  Description of Artificial Sequence: Synthetic primer
tacagtcatccctcccaaaataagtt

SEQ ID NO: 609 - DNA, 22 bp, Artificial Sequence
  Description of Artificial Sequence: Synthetic primer
gtaatgttggcgttgtctctgg

SEQ ID NO: 610 - DNA, 30 bp, Artificial Sequence
  Description of Artificial Sequence: Synthetic primer
ggaatattcactacatcctactacattctt

SEQ ID NO: 611 - DNA, 23 bp, Artificial Sequence
  Description of Artificial Sequence: Synthetic primer
atttatggggcaagcctttaaga

SEQ ID NO: 612 - DNA, 25 bp, Artificial Sequence
  Description of Artificial Sequence: Synthetic primer
ggtttatcaaaggtatttctgactg

SEQ ID NO: 613 - DNA, 23 bp, Artificial Sequence
  Description of Artificial Sequence: Synthetic primer
gcctcctttctttttgacttacg

SEQ ID NO: 614 - DNA, 22 bp, Artificial Sequence
  Description of Artificial Sequence: Synthetic primer
acaggccttccaatgcctaaga

SEQ ID NO: 615 - DNA, 22 bp, Artificial Sequence
  Description of Artificial Sequence: Synthetic primer
tttcttaaggacacctgtgtga

SEQ ID NO: 616 - DNA, 23 bp, Artificial Sequence
  Description of Artificial Sequence: Synthetic primer
aaagtccagctcagcaatgtttt

SEQ ID NO: 617 - DNA, 22 bp, Artificial Sequence
  Description of Artificial Sequence: Synthetic primer
aagttgtgcgtaaaggtcaaag

SEQ ID NO: 618 - DNA, 27 bp, Artificial Sequence
  Description of Artificial Sequence: Synthetic primer
gtgtttgcaggtaaattgtaaaaatcc

SEQ ID NO: 619 - DNA, 24 bp, Artificial Sequence
  Description of Artificial Sequence: Synthetic primer
gaaaagggattttacatcttcaaa

SEQ ID NO: 620 - DNA, 23 bp, Artificial Sequence
  Description of Artificial Sequence: Synthetic primer
ggtctacagaaaggaggagttga

SEQ ID NO: 621 - DNA, 21 bp, Artificial Sequence
  Description of Artificial Sequence: Synthetic primer
tagtgaagcagttggatggat

SEQ ID NO: 622 - DNA, 28 bp, Artificial Sequence
  Description of Artificial Sequence: Synthetic primer
aaaatagacaataacctagctgtcattc

SEQ ID NO: 623 - DNA, 24 bp, Artificial Sequence
  Description of Artificial Sequence: Synthetic primer
aggcttattttacaaagggggata

SEQ ID NO: 624 - DNA, 24 bp, Artificial Sequence
  Description of Artificial Sequence: Synthetic primer
tacttctgcaaagattttcccatt

SEQ ID NO: 625 - DNA, 24 bp, Artificial Sequence
  Description of Artificial Sequence: Synthetic primer
ttaaagcacttccagcttttcatc

SEQ ID NO: 626 - DNA, 19 bp, Artificial Sequence
  Description of Artificial Sequence: Synthetic primer
cttgtcggttgctttcaga

SEQ ID NO: 627 - DNA, 22 bp, Artificial Sequence
  Description of Artificial Sequence: Synthetic primer
agacgaaggaccttacaagctg

SEQ ID NO: 628 - DNA, 19 bp, Artificial Sequence
  Description of Artificial Sequence: Synthetic primer
tgtccacccgtctgctttc

SEQ ID NO: 629 - DNA, 21 bp, Artificial Sequence
  Description of Artificial Sequence: Synthetic primer
ccctcctcccgtgtaagtttc

SEQ ID NO: 630 - DNA, 22 bp, Artificial Sequence
  Description of Artificial Sequence: Synthetic primer
tctcccagctaaaaacttcaac

SEQ ID NO: 631 - DNA, 23 bp, Artificial Sequence
  Description of Artificial Sequence: Synthetic primer
tcttttaaaatgggtcattgtgc

SEQ ID NO: 632 - DNA, 26 bp, Artificial Sequence
  Description of Artificial Sequence: Synthetic primer
aaatttgtatctgaaacacttctcct

SEQ ID NO: 633 - DNA, 25 bp, Artificial Sequence
  Description of Artificial Sequence: Synthetic primer
ggttggcaaattttatttccactta

SEQ ID NO: 634 - DNA, 27 bp, Artificial Sequence
  Description of Artificial Sequence: Synthetic primer
cctacttcaataggctatggctatact

SEQ ID NO: 635 - DNA, 28 bp, Artificial Sequence
  Description of Artificial Sequence: Synthetic primer
tcctgaaatttactaaggaagctatgta

SEQ ID NO: 636 - DNA, 24 bp, Artificial Sequence
  Description of Artificial Sequence: Synthetic primer
ttatcaactttccccagtgtagag

SEQ ID NO: 637 - DNA, 25 bp, Artificial Sequence
  Description of Artificial Sequence: Synthetic primer
tttaaaaataccttgtagggagcac

SEQ ID NO: 638 - DNA, 27 bp, Artificial Sequence
  Description of Artificial Sequence: Synthetic primer
tgttttatgttggatactggtattacg

SEQ ID NO: 639 - DNA, 27 bp, Artificial Sequence
  Description of Artificial Sequence: Synthetic primer
aaaaatgttttaaatctttctgtcaac

SEQ ID NO: 640 - DNA, 24 bp, Artificial Sequence
  Description of Artificial Sequence: Synthetic primer
agttgctgcagaaaacatgtatgg

SEQ ID NO: 641 - DNA, 19 bp, Artificial Sequence
  Description of Artificial Sequence: Synthetic primer
aggggtttggcaagggtta

SEQ ID NO: 642 - DNA, 28 bp, Artificial Sequence
  Description of Artificial Sequence: Synthetic primer
ggtctccagacctctactctatactcat

SEQ ID NO: 643 - DNA, 28 bp, Artificial Sequence
  Description of Artificial Sequence: Synthetic primer
ttcacttaatattctaaaagttgaggtc

SEQ ID NO: 644 - DNA, 24 bp, Artificial Sequence
  Description of Artificial Sequence: Synthetic primer
tgctgctccaataaatacaggttt

SEQ ID NO: 645 - DNA, 30 bp, Artificial Sequence
  Description of Artificial Sequence: Synthetic primer
tgaattatatctcaataaagctgttaaaaa

SEQ ID NO: 646 - DNA, 24 bp, Artificial Sequence
  Description of Artificial Sequence: Synthetic primer
atgaagagtggagaagagccaatc

SEQ ID NO: 647 - DNA, 25 bp, Artificial Sequence
  Description of Artificial Sequence: Synthetic primer
tccaattcctctgctgtatattttg

SEQ ID NO: 648 - DNA, 27 bp, Artificial Sequence
  Description of Artificial Sequence: Synthetic primer
tcacagataagtccaattattttaccc

SEQ ID NO: 649 - DNA, 30 bp, Artificial Sequence
  Description of Artificial Sequence: Synthetic primer
caacacagttattctttaaatacagttcta

SEQ ID NO: 650 - DNA, 21 bp, Artificial Sequence
  Description of Artificial Sequence: Synthetic primer
tcatcttgtgtatgtgccttg

SEQ ID NO: 651 - DNA, 26 bp, Artificial Sequence
  Description of Artificial Sequence: Synthetic primer
gcataagttcaaactctacatttgtt

SEQ ID NO: 652 - DNA, 24 bp, Artificial Sequence
  Description of Artificial Sequence: Synthetic primer
ccaaccaaaacctaaggaaaacac

SEQ ID NO: 653 - DNA, 18 bp, Artificial Sequence
  Description of Artificial Sequence: Synthetic primer
tgatgtgctgctggaaaa

SEQ ID NO: 654 - DNA, 22 bp, Artificial Sequence
  Description of Artificial Sequence: Synthetic primer
tcagtgctaagcaggggtcact

SEQ ID NO: 655 - DNA, 23 bp, Artificial Sequence
  Description of Artificial Sequence: Synthetic primer
tggattctggagaatgtaggtag

SEQ ID NO: 656 - DNA, 28 bp, Artificial Sequence
  Description of Artificial Sequence: Synthetic primer
tttcatatctattgctctaagacatttt

SEQ ID NO: 657 - DNA, 19 bp, Artificial Sequence
  Description of Artificial Sequence: Synthetic primer
aagcctggaccaaagtcaa

SEQ ID NO: 658 - DNA, 22 bp, Artificial Sequence
  Description of Artificial Sequence: Synthetic primer
tggccttgtgatatggcactac

SEQ ID NO: 659 - DNA, 18 bp, Artificial Sequence
  Description of Artificial Sequence: Synthetic primer
tgggtggggcgatagaaa

SEQ ID NO: 660 - DNA, 27 bp, Artificial Sequence
  Description of Artificial Sequence: Synthetic primer
ttgtttcattctttgctttaactctcc

SEQ ID NO: 661 - DNA, 25 bp, Artificial Sequence
  Description of Artificial Sequence: Synthetic primer
acaagacaattttcctccctctaag

SEQ ID NO: 662 - DNA, 25 bp, Artificial Sequence
  Description of Artificial Sequence: Synthetic primer
cttaatcttttgaaactatgcttgg

SEQ ID NO: 663 - DNA, 25 bp, Artificial Sequence
  Description of Artificial Sequence: Synthetic primer
tcaaaacaacatttttgtctccttt

SEQ ID NO: 664 - DNA, 25 bp, Artificial Sequence
  Description of Artificial Sequence: Synthetic primer
gcgcactcaaattaaagtcactcat

SEQ ID NO: 665 - DNA, 25 bp, Artificial Sequence
  Description of Artificial Sequence: Synthetic primer
tgttttgctgagttttctttatgcc

SEQ ID NO: 666 - DNA, 22 bp, Artificial Sequence
  Description of Artificial Sequence: Synthetic primer
aaaatctgctgaaccagccaca

SEQ ID NO: 667 - DNA, 25 bp, Artificial Sequence
  Description of Artificial Sequence: Synthetic primer
tgatggtgggtctaagattacaaac

SEQ ID NO: 668 - DNA, 22 bp, Artificial Sequence
  Description of Artificial Sequence: Synthetic primer
tcatcttgttagatgccccttc

SEQ ID NO: 669 - DNA, 22 bp, Artificial Sequence
  Description of Artificial Sequence: Synthetic primer
attgcatatatacgtgcgtttg

SEQ ID NO: 670 - DNA, 24 bp, Artificial Sequence
  Description of Artificial Sequence: Synthetic primer
ccaatttcatctttctggaatagc

SEQ ID NO: 671 - DNA, 19 bp, Artificial Sequence
  Description of Artificial Sequence: Synthetic primer
gggacactagccagattgg

SEQ ID NO: 672 - DNA, 24 bp, Artificial Sequence
  Description of Artificial Sequence: Synthetic primer
ttcaggccgaatttgggattgttt

SEQ ID NO: 673 - DNA, 19 bp, Artificial Sequence
  Description of Artificial Sequence: Synthetic primer
tgagcagacatggccctcc

SEQ ID NO: 674 - DNA, 23 bp, Artificial Sequence
  Description of Artificial Sequence: Synthetic primer
agaagtgcttacagtcctctgaa

SEQ ID NO: 675 - DNA, 25 bp, Artificial Sequence
  Description of Artificial Sequence: Synthetic primer
cagataatgacttcaatgaaagcta

SEQ ID NO: 676 - DNA, 18 bp, Artificial Sequence
  Description of Artificial Sequence: Synthetic primer
gtggcctttgccctccct

SEQ ID NO: 677 - DNA, 18 bp, Artificial Sequence
  Description of Artificial Sequence: Synthetic primer
ggtgcccttcatcctgcg

SEQ ID NO: 678 - DNA, 18 bp, Artificial Sequence
  Description of Artificial Sequence: Synthetic primer
tcgtcggaaggcgaagat

SEQ ID NO: 679 - DNA, 25 bp, Artificial Sequence
  Description of Artificial Sequence: Synthetic primer
aaataagtttcgaactctggcacct

SEQ ID NO: 680 - DNA, 37 bp, Artificial Sequence
  Description of Artificial Sequence: Synthetic oligonucleotide
  misc_feature (36)..(37): Phosphorothioate linkage
acactctttccctacacgacgctcttccgatctaact

SEQ ID NO: 681 - DNA, 36 bp, Artificial Sequence
  Description of Artificial Sequence: Synthetic oligonucleotide
  misc_feature (1)..(1): 5' phosphate
gttagatcggaagagcggttcagcaggaatgccgag

SEQ ID NO: 682 - DNA, 37 bp, Artificial Sequence
  Description of Artificial Sequence: Synthetic oligonucleotide
  misc_feature (36)..(37): Phosphorothioate linkage
acactctttccctacacgacgctcttccgatctaggt

SEQ ID NO: 683 - DNA, 36 bp, Artificial Sequence
  Description of Artificial Sequence: Synthetic oligonucleotide
  misc_feature (1)..(1): 5' phosphate
cctagatcggaagagcggttcagcaggaatgccgag

SEQ ID NO: 684 - DNA, 37 bp, Artificial Sequence
  Description of Artificial Sequence: Synthetic oligonucleotide
  misc_feature (36)..(37): Phosphorothioate linkage
acactctttccctacacgacgctcttccgatctatgt

SEQ ID NO: 685 - DNA, 36 bp, Artificial Sequence
  Description of Artificial Sequence: Synthetic oligonucleotide
  misc_feature (1)..(1): 5' phosphate
catagatcggaagagcggttcagcaggaatgccgag

SEQ ID NO: 686 - DNA, 37 bp, Artificial Sequence
  Description of Artificial Sequence: Synthetic oligonucleotide
  misc_feature (36)..(37): Phosphorothioate linkage
acactctttccctacacgacgctcttccgatctcact

SEQ ID NO: 687 - DNA, 36 bp, Artificial Sequence
  Description of Artificial Sequence: Synthetic oligonucleotide
  misc_feature (1)..(1): 5' phosphate
gtgagatcggaagagcggttcagcaggaatgccgag

SEQ ID NO: 688 - DNA, 37 bp, Artificial Sequence
  Description of Artificial Sequence: Synthetic oligonucleotide
  misc_feature (36)..(37): Phosphorothioate linkage
acactctttccctacacgacgctcttccgatctcgat

SEQ ID NO: 689 - DNA, 36 bp, Artificial Sequence
  Description of Artificial Sequence: Synthetic oligonucleotide
  misc_feature (1)..(1): 5' phosphate
tcgagatcggaagagcggttcagcaggaatgccgag

SEQ ID NO: 690 - DNA, 37 bp, Artificial Sequence
  Description of Artificial Sequence: Synthetic oligonucleotide
  misc_feature (36)..(37): Phosphorothioate linkage
acactctttccctacacgacgctcttccgatctggat

SEQ ID NO: 691 - DNA, 36 bp, Artificial Sequence
  Description of Artificial Sequence: Synthetic oligonucleotide
  misc_feature (1)..(1): 5' phosphate
tccagatcggaagagcggttcagcaggaatgccgag

SEQ ID NO: 692 - DNA, 37 bp, Artificial Sequence
  Description of Artificial Sequence: Synthetic oligonucleotide
  misc_feature (36)..(37): Phosphorothioate linkage
acactctttccctacacgacgctcttccgatctgtct

SEQ ID NO: 693 - DNA, 36 bp, Artificial Sequence
  Description of Artificial Sequence: Synthetic oligonucleotide
  misc_feature (1)..(1): 5' phosphate
gacagatcggaagagcggttcagcaggaatgccgag

SEQ ID NO: 694 - DNA, 37 bp, Artificial Sequence
  Description of Artificial Sequence: Synthetic oligonucleotide
  misc_feature (36)..(37): Phosphorothioate linkage
acactctttccctacacgacgctcttccgatcttcgt

SEQ ID NO: 695 - DNA, 36 bp, Artificial Sequence
  Description of Artificial Sequence: Synthetic oligonucleotide
  misc_feature (1)..(1): 5' phosphate
cgaagatcggaagagcggttcagcaggaatgccgag

SEQ ID NO: 696 - DNA, 37 bp, Artificial Sequence
  Description of Artificial Sequence: Synthetic oligonucleotide
  misc_feature (36)..(37): Phosphorothioate linkage
acactctttccctacacgacgctcttccgatcttgat

SEQ ID NO: 697 - DNA, 36 bp, Artificial Sequence
  Description of Artificial Sequence: Synthetic oligonucleotide
  misc_feature (1)..(1): 5' phosphate
tcaagatcggaagagcggttcagcaggaatgccgag

SEQ ID NO: 698 - DNA, 37 bp, Artificial Sequence
  Description of Artificial Sequence: Synthetic oligonucleotide
  misc_feature (36)..(37): Phosphorothioate linkage
acactctttccctacacgacgctcttccgatctttct

SEQ ID NO: 699 - DNA, 36 bp, Artificial Sequence
  Description of Artificial Sequence: Synthetic oligonucleotide
  misc_feature (1)..(1): 5' phosphate
gaaagatcggaagagcggttcagcaggaatgccgag

SEQ ID NO: 700 - DNA, 36 bp, Artificial Sequence
  Description of Artificial Sequence: Synthetic oligonucleotide
  misc_feature (1)..(1): 5' phosphate
cgtagatcggaagagcggttcagcaggaatgccgag

SEQ ID NO: 701 - DNA, 37 bp, Artificial Sequence
  Description of Artificial Sequence: Synthetic oligonucleotide
  misc_feature (36)..(37): Phosphorothioate linkage
acactctttccctacacgacgctcttccgatctacgt

SEQ ID NO: 702 - DNA, 36 bp, Artificial Sequence
  Description of Artificial Sequence: Synthetic oligonucleotide
  misc_feature (1)..(1): 5' phosphate
gctagatcggaagagcggttcagcaggaatgccgag

SEQ ID NO: 703 - DNA, 37 bp, Artificial Sequence
  Description of Artificial Sequence: Synthetic oligonucleotide
  misc_feature (36)..(37): Phosphorothioate linkage
acactctttccctacacgacgctcttccgatctagct

SEQ ID NO: 704 - DNA, 36 bp, Artificial Sequence
  Description of Artificial Sequence: Synthetic oligonucleotide
  misc_feature (1)..(1): 5' phosphate
ccaagatcggaagagcggttcagcaggaatgccgag

SEQ ID NO: 705 - DNA, 37 bp, Artificial Sequence
  Description of Artificial Sequence: Synthetic oligonucleotide
  misc_feature (36)..(37): Phosphorothioate linkage
acactctttccctacacgacgctcttccgatcttggt

SEQ ID NO: 706 - DNA, 36 bp, Artificial Sequence
  Description of Artificial Sequence: Synthetic oligonucleotide
  misc_feature (1)..(1): 5' phosphate
ggaagatcggaagagcggttcagcaggaatgccgag

SEQ ID NO: 707 - DNA, 37 bp, Artificial Sequence
  Description of Artificial Sequence: Synthetic oligonucleotide
  misc_feature (36)..(37): Phosphorothioate linkage
acactctttccctacacgacgctcttccgatcttcct

SEQ ID NO: 708 - DNA, 36 bp, Artificial Sequence
  Description of Artificial Sequence: Synthetic oligonucleotide
  misc_feature (1)..(1): 5' phosphate
gtcagatcggaagagcggttcagcaggaatgccgag

SEQ ID NO: 709 - DNA, 37 bp, Artificial Sequence
  Description of Artificial Sequence: Synthetic oligonucleotide
  misc_feature (36)..(37): Phosphorothioate linkage
acactctttccctacacgacgctcttccgatctgact

SEQ ID NO: 710 - DNA, 36 bp, Artificial Sequence
  Description of Artificial Sequence: Synthetic oligonucleotide
  misc_feature (1)..(1): 5' phosphate
acgagatcggaagagcggttcagcaggaatgccgag

SEQ ID NO: 711 - DNA, 37 bp, Artificial Sequence
  Description of Artificial Sequence: Synthetic oligonucleotide
  misc_feature (36)..(37): Phosphorothioate linkage
acactctttccctacacgacgctcttccgatctcgtt

SEQ ID NO: 712 - DNA, 36 bp, Artificial Sequence
  Description of Artificial Sequence: Synthetic oligonucleotide
  misc_feature (1)..(1): 5' phosphate
cacagatcggaagagcggttcagcaggaatgccgag

SEQ ID NO: 713 - DNA, 37 bp, Artificial Sequence
  Description of Artificial Sequence: Synthetic oligonucleotide
  misc_feature (36)..(37): Phosphorothioate linkage
acactctttccctacacgacgctcttccgatctgtgt

SEQ ID NO: 714 - DNA, 36 bp, Artificial Sequence
  Description of Artificial Sequence: Synthetic oligonucleotide
  misc_feature (1)..(1): 5' phosphate
gagagatcggaagagcggttcagcaggaatgccgag

SEQ ID NO: 715 - DNA, 37 bp, Artificial Sequence
  Description of Artificial Sequence: Synthetic oligonucleotide
  misc_feature (36)..(37): Phosphorothioate linkage
acactctttccctacacgacgctcttccgatctctct

SEQ ID NO: 716 - DNA, 36 bp, Artificial Sequence
  Description of Artificial Sequence: Synthetic oligonucleotide
  misc_feature (1)..(1): 5' phosphate
ctgagatcggaagagcggttcagcaggaatgccgag

SEQ ID NO: 717 - DNA, 37 bp, Artificial Sequence
  Description of Artificial Sequence: Synthetic oligonucleotide
  misc_feature (36)..(37): Phosphorothioate linkage
acactctttccctacacgacgctcttccgatctcagt

SEQ ID NO: 718 - DNA, 36 bp, Artificial Sequence
  Description of Artificial Sequence: Synthetic oligonucleotide
  misc_feature (1)..(1): 5' phosphate
tgcagatcggaagagcggttcagcaggaatgccgag

SEQ ID NO: 719 - DNA, 37 bp, Artificial Sequence
  Description of Artificial Sequence: Synthetic oligonucleotide
  misc_feature (36)..(37): Phosphorothioate linkage
acactctttccctacacgacgctcttccgatctgcat

SEQ ID NO: 720 - DNA, 28 bp, Artificial Sequence
  Description of Artificial Sequence: Synthetic primer
tgaggagctgtaagagaatgtcatcaga

SEQ ID NO: 721 - DNA, 25 bp, Artificial Sequence
  Description of Artificial Sequence: Synthetic primer
agtgctggcattaccactcctagtt

SEQ ID NO: 722 - DNA, 11 bp, Artificial Sequence
  Description of Artificial Sequence: Synthetic oligonucleotide
cacactccata

SEQ ID NO: 723 - DNA, 13 bp, Artificial Sequence
  Description of Artificial Sequence: Synthetic oligonucleotide
gtcaagatatctg

SEQ ID NO: 724 - DNA, 14 bp, Artificial Sequence
  Description of Artificial Sequence: Synthetic oligonucleotide
acagatatcttgac

SEQ ID NO: 725 - protein, 19000 aa, Homo sapiens
SISKESFPVQWKRDDKTLESGDKYDVIADGKKRVLVVKDATLQDMGTYVVMVGAARAAAHLTVIEKLRIVVPLKDTRVKEQQEVVFNCEVNTEGAKAKWFRNEEAIFDSSKYIILQKDLVYTLRIRDAHLDDQANYNVSLTNHRGENVKSAANLIVEEEDLRIVEPLKDIETMEKKSVTFWCKVNRLNVTLKWTKNGEEVPFDNRVSYRVDKYKHMLTIKDCGFPDEGEYIVTAGQDKSVAELLIIEAPTEFVEHLEDQTVTEFDDAVFSCQLSREKANVKWYRNGREIKEGKKYKFEKDGSIHRLIIKDCRLDDECEYACGVEDRKSRARLFVEEIPVEIIRPPQDILEAPGADVVFLAELNKDKVEVQWLRNNMVVVQGDKHQMMSEGKIHRLQICDIKPRDQGEYRFIAKDKEARAKLELAAAPKIKTADQDLVVDVGKPLTMVVPYDAYPKAEAEWFKENEPLSTKTIDTTAEQTSFRILEAKKGDKGRYKIVLQNKHGKAEGFINLKVIDVPGPVRNLEVTETFDGEVSLAWEEPLTDGGSKIIGYVVERRDIKRKTWVLATDRAESCEFTVTGLQKGGVEYLFRVSARNRVGTGEPVETDNPVEARSKYDVPGPPLNVTITDVNRFGVSLTWEPPEYDGGAEITNYVIELRDKTSIRWDTAMTVRAEDLSATVTDVVEGQEYSFRVRAQNRIGVGKPSAATPFVKVADPIERPSPPVNLTSSDQTQSSVQLKWEPPLKDGGSPILGYIIERCEEGKDNWIRCNMKLVPELTYKVTGLEKGNKYLYRVSAENKAGVSDPSEILGPLTADDAFVEPTMDLSAFKDGLEVIVPNPITILVPSTGYPRPTATWCFGDKVLETGDRVKMKTLSAYAELVISPSERSDKGIYTLKLENRVKTISGEIDVNVIARPSAPKELKFGDITKDSVHLTWEPPDDDGGSPLTGYVVEKREVSRKTWTKVMDFVTDLEFTVPDLVQGKEYLFKVCARNKCGPGEPAYVDEPVNMSTPATVPDPPENVKWRDRTANSIFLTWDPPKNDGGSRIKGYIVERCPRGSDKWVACGEPVAETKMEVTGLEEGKWYAYRVKALNRQGASKPSRPTEEIQAVDTQEAPEIFLDVKLLAGLTVKAGTKIELPATVTGKPEPKITWTKADMILKQDKRITIENVPKKSTVTIVDSKRSDTGTYIIEAVNVCGRATAVVEVNVLDKPGPPAAFDITDVTNESCLLTWNPPRDDGGSKITNYVVERRATDSEVWHKLSSTVKDTNFKATKLIPNKEYIFRVAAENMYGVGEPVQASPITAKYQFDPPGPPTRLEPSDITKDAVTLTWCEPDDDGGSPITGYWVERLDPDTDKWVRCNKMPVKDTTYRVKGLTNKKKYRFRVLAENLAGPGKPSKSTEPILIKDPIDPPWPPGKPTVKDVGKTSVRLNWTKPEHDGGAKIESYVIEMLKTGTDEWVRVAEGVPTTQHLLPGLMEGQEYSFRVRAVNKAGESEPSEPSDPVLCREKLYPPSPPRWLEVINITKNTADLKWTVPEKDGGSPITNYIVEKRDVRRKGWQTVDTTVKDTKCTVTPLTEGSLYVFRVAAENAIGQSDYTEIEDSVLAKDTFTTPGPPYALAVVDVTKRHVDLKWEPPKNDGGRPIQRYVIEKKERLGTRWVKAGKTAGPDCNFRVTDVIEGTEVQFQVRAENEAGVGHPSEPTEILSIEDPTSPPSPPLDLHVTDAGRKHIAIAWKPPEKNGGSPIIGYHVEMCPVGTEKWMRVNSRPIKDLKFKVEEGVVPDKEYVLRVRAVNAIGVSEPSEISENVVAKDPDCKPTIDLETHDIIVIEGEKLSIPVPFRAVPVPTVSWHKDGKEVKASDRLTMKNDHISAHLEVPKSVRADAGIYTITLENKLGSATASINVKVIGLPGPCKDIKASDITKSSCKLTWEPPEFDGGTPILHYVLERREAGRRTYIPVMSGENKLSWTVKDLIPNGEYFFRVKAVNKVGGGEYIELKNPVIAQDPKQPPDPPVDVEVHNPTAEAMTITWKPPLYDGGSKIMGYIIEKIAKGEERWKRCNEHLVPILTYTAKGLEEGKEYQFRVRAENAAGISEPSRATPPTKAVDPIDAPKVILRTSLEVKRGDEIALDASISGSPYPTITWIKDENVIVPEEIKKRAAPLVRRRKGEVQEEEPFVLPLTQRLSIDNSKKGESQLRVRDSLRPDHGLYMIKVENDHGIAKAPCTVSVLDTPGPPINFVFEDIRKTSVLCKWEPPLDDGGSEIINYTLEKKDKTKPDSEWIVVTSTLRHCKYSVTKLIEGKEYLFRVRAENRFGPGPPCVSKPLVAKDPFGPPDAPDKPIVEDVTSNSMLVKWNEPKDNGSPILGYWLEKREVNSTHWSRVNKSLLNALKANVDGLLEGLTYVFRVCAENAAGPGKFSPPSDPKTAHDPISPPGPPIPRVTDTSSTTIELEWEPPAFNGGGEIVGYFVDKQLVGTNEWSRCTEKMIKVRQYTVKEIREGADYKLRVSAVNAAGEGPPGETQPVTVAEPQEPPAVELDVSVKGGIQIMAGKTLRIPAVVTGRPVPTKVWTKEEGELDKDRVVIDNVGTKSELIIKDALRKDHGRYVITATNSCGSKFAAARVEVFDVPGPVLDLKPVVTNRKMCLLNWSDPEDDGGSEITGFIIERKDAKMHTWRQPIETERSKCDITGLLEGQEYKFRVIAKNKFGCGPPVEIGPILAVDPLGPPTSPERLTYTERTKSTITLDWKEPRSNGGSPIQGYIIEKRRHDKPDFERVNKRLCPTTSFLVENLDEHQMYEFRVKAVNEIGESEPSLPLNVVIQDDEVPPTIKLRLSVRGDTIKVKAGEPVHIPADVTGLPMPKIEWSKNETVIEKPTDALQITKEEVSRSEAKTELSIPKAVREDKGTYTVTASNRLGSVFRNVHVEVYDRPSPPRNLAVTDIKAESCYLTWDAPLDNGGSEITHYVIDKRDASRKKAEWEEVTNTAVEKRYGIWKLIPNGQYEFRVRAVNKYGISDECKSDKVVIQDPYRLPGPPGKPKVLARTKGSMLVSWTPPLDNGGSPITGYWLEKREEGSPYWSRVSRAPITKVGLKGVEFNVPRLLEGVKYQFRAMAINAAGIGPPSEPSDPEVAGDPIFPPGPPSCPEVKDKTKSSISLGWKPPAKDGGSPIKGYIVEMQEEGTTDWKRVNEPDKLITTCECVVPNLKELRKYRFRVKAVNEAGESEPSDTTGEIPATDIQEEPEVFIDIGAQDCLVCKAGSQIRIPAVIKGRPTPKSSWEFDGKAKKAMKDGVHDIPEDAQLETAENSSVIIIPECKRSHTGKYSITAKNKAGQKTANCRVKVMDVPGPPKDLKVSDITRGSCRLSWKMPDDDGGDRIKGYVIEKRTIDGKAWTKVNPDCGSTTFVVPDLLSEQQYFFRVRAENRFGIGPPVETIQRTTARDPIYPPDPPIKLKIGLITKNTVHLSWKPPKNDGGSPVTHYIVECLAWDPTGTKKEAWRQCNKRDVEELQFTVEDLVEGGEYEFRVKAVNAAGVSKPSATVGPCDCQRPDMPPSIDLKEFMEVEEGTNVNIVAKIKGVPFPTLTWFKAPPKKPDNKEPVLYDTHVNKLVVDDTCTLVIPQSRRSDTGLYTITAVNNLGTASKEMRLNVLGRPGPPVGPIKFESVSADQMTLSWFPPKDDGGSKITNYVIEKREANRKTWVHVSSEPKECTYTIPKLLEGHEYVFRIMAQNKYGIGEPLDSEPETARNLFSVPGAPDKPTVSSVTRNSMTVNWEEPEYDGGSPVTGYWLEMKDTTSKRWKRVNRDPIKAMTLGVSYKVTGLIEGSDYQFRVYAINAAGVGPASLPSDPATARDPIAPPGPPFPKVTDWTKSSADLEWSPPLKDGGSKVTGYIVEYKEEGKEEWEKGKDKEVRGTKLVVTGLKEGAFYKFRVSAVNIAGIGEPGEVTDVIEMKDRLVSPDLQLDASVRDRIVVHAGGVIRIIAYVSGKPPPTVTWNMNERTLPQEATIETTAISSSMVIKNCQRSHQGVYSLLAKNEAGERKKTIIVDVLDVPGPVGTPFLAHNLTNESCKLTWFSPEDDGGSPITNYVIEKRESDRRAWTPVTYTVTRQNATVQGLIQGKAYFFRIAAENSIGMGPFVETSEALVIREPITVPERPEDLEVKEVTKNTVTLTWNPPKYDGGSEIINYVLESRLIGTEKFHKVTNDNLLSRKYTVKGLKEGDTYEYRVSAVNIVGQGKPSFCTKPITCKDELAPPTLHLDFRDKLTIRVGEAFALTGRYSGKPKPKVSWFKDEADVLEDDRTHIKTTPATLALEKIKAKRSDSGKYCVVVENSTGSRKGFCQVNVVDRPGPPVGPVSFDEVTKDYMVISWKPPLDDGGSKITNYIIEKKEVGKDVWMPVTSASAKTTCKVSKLLEGKDYIFRIHAENLYGISDPLVSDSMKAKDRFRVPDAPDQPIVTEVTKDSALVTWNKPHDGGKPITNYILEKRETMSKRWARVTKDPIHPYTKFRVPDLLEGCQYEFRVSAENEIGIGDPSPPSKPVFAKDPIAKPSPPVNPEAIDTTCNSVDLTWQPPRHDGGSKILGYIVEYQKVGDEEWRRANHTPESCPETKYKVTGLRDGQTYKFRVLAVNAAGESDPAHVPEPVLVKDRLEPPELILDANMAREQHIKVGDTLRLSAIIKGVPFPKVTWKKEDRDAPTKARIDVTPVGSKLEIRNAAHEDGGIYSLTVENPAGSKTVSVKVLVLDKPGPPRDLEVSEIRKDSCYLTWKEPLDDGGSVITNYVVERRDVASAQWSPLSATSKKKSHFAKHLNEGNQYLFRVAAENQYGRGPFVETPKPIKALDPLHPPGPPKDLHHVDVDKTEVSLVWNKPDRDGGSPITGYLVEYQEEGTQDWIKFKTVTNLECVVTGLQQGKTYRFRVKAENIVGLGLPDTTIPIECQEKLVPPSVELDVKLIEGLVVKAGTTVRFPAIIRGVPVPTAKWTTDGSEIKTDEHYTVETDNFSSVLTIKNCLRRDTGEYQITVSNAAGSKTVAVHLTVLDVPGPPTGPINILDVTPEHMTISWQPPKDDGGSPVINYIVEKQDTRKDTWGVVSSGSSKTKLKIPHLQKGCEYVFRVRAENKIGVGPPLDSTPTVAKHKFSPPSPPGKPVVTDITENAATVSWTLPKSDGGSPITGYYMERREVTGKWVRVNKTPIADLKFRVTGLYEGNTYEFRVFAENLAGLSKPSPSSDPIKACRPIKPPGPPINPKLKDKSRETADLVWTKPLSDGGSPILGYVVECQKPGTAQWNRINKDELIRQCAFRVPGLIEGNEYRFRIKAANIVGEGEPRELAESVIAKDILHPPEVELDVTCRDVITVRVGQTIRILARVKGRPEPDITWTKEGKVLVREKRVDLIQDLPRVELQIKEAVRADHGKYIISAKNSSGHAQGSAIVNVLDRPGPCQNLKVTNVTKENCTISWENPLDNGGSEITNFIVEYRKPNQKGWSIVASDVTKRLIKANLLANNEYYFRVCAENKVGVGPTIETKTPILAINPIDRPGEPENLHIADKGKTFVYLKWRRPDYDGGSPNLSYHVERRLKGSDDWERVHKGSIKETHYMVDRCVENQIYEFRVQTKNEGGESDWVKTEEVVVKEDLQKPVLDLKLSGVLTVKAGDTIRLEAGVRGKPFPEVAWTKDKDATDLTRSPRVKIDTRADSSKFSLTKAKRSDGGKYVVTATNTAGSFVAYATVNVLDKPGPVRNLKIVDVSSDRCTVCWDPPEDDGGCEIQNYILEKCETKRMVWSTYSATVLTPGTTVTRLIEGNEYIFRVRAENKIGTGPPTESKPVIAKTKYDKPGRPDPPEVTKVSKEEMTVVWNPPEYDGGKSITGYFLEKKEKHSTRWVPVNKSAIPERRMKVQNLLPDHEYQFRVKAENEIGIGEPSLPSRPVVAKDPIEPPGPPTNFRVVDTTKHSITLGWGKPVYDGGAPIIGYVVEMRPKIADASPDEGWKRCNAAAQLVRKEFTVTSLDENQEYEFRVCAQNQVGIGRPAELKEAIKPKEILEPPEIDLDASMRKLVIVRAGCPIRLFAIVRGRPAPKVTWRKVGIDNVVRKGQVDLVDTMAFLVIPNSTRDDSGKYSLTLVNPAGEKAVFVNVRVLDTPGPVSDLKVSDVTKTSCHVSWAPPENDGGSQVTHYIVEKREADRKTWSTVTPEVKKTSFHVTNLVPGNEYYFRVTAVNEYGPGVPTDVPKPVLASDPLSEPDPPRKLEVTEMTKNSATLAWLPPLRDGGAKIDGYITSYREEEQPADRWTEYSVVKDLSLVVTGLKEGKKYKFRVAARNAVGVSLPREAEGVYEAKEQLLPPKILMPEQITIKAGKKLRIEAHVYGKPHPTCKWKKGEDEVVTSSHLAVHKADSSSILIIKDVTRKDSGYYSLTAENSSGTDTQKIKVVVMDAPGPPQPPFDISDIDADACSLSWHIPLEDGGSNITNYIVEKCDVSRGDWVTALASVTKTSCRVGKLIPGQEYIFRVRAENRFGISEPLTSPKMVAQFPFGVPSEPKNARVTKVNKDCIFVAWDRPDSDGGSPIIGYLIERKERNSLLWVKANDTLVRSTEYPCAGLVEGLEYSFRIYALNKAGSSPPSKPTEYVTARMPVDPPGKPEVIDVTKSTVSLIWARPKHDGGSKIIGYFVEACKLPGDKWVRCNTAPHQIPQEEYTATGLEEKAQYQFRAIARTAVNISPPSEPSDPVTILAENVPPRIDLSVAMKSLLTVKAGTNVCLDATVFGKPMPTVSWKKDGTLLKPAEGIKMAMQRNLCTLELFSVNRKDSGDYTITAENSSGSKSATIKLKVLDKPGPPASVKINKMYSDRAMLSWEPPLEDGGSEITNYIVDKRETSRPNWAQVSATVPITSCSVEKLIEGHEYQFRICAENKYGVGDPVFTEPAIAKNPYDPPGRCDPPVISNITKDHMTVSWKPPADDGGSPITGYLLEKRETQAVNWTKVNRKPIIERTLKATGLQEGTEYEFRVTAINKAGPGKPSDASKAAYARDPQYPPAPPAFPKVYDTTRSSVSLSWGKPAYDGGSPIIGYLVEVKRADSDNWVRCNLPQNLQKTRFEVTGLMEDTQYQFRVYAVNKIGYSDPSDVPDKHYPKDILIPPEGELDADLRKTLILRAGVTMRLYVPVKGRPPPKITWSKPNVNLRDRIGLDIKSTDFDTFLRCENVNKYDAGKYILTLENSCGKKEYTIVVKVLDTPGPPVNVTVKEISKDSAYVTWEPPIIDGGSPIINYVVQKRDAERKSWSTVTTECSKTSFRVANLEEGKSYFFRVFAENEYGIGDPGETRDAVKASQTPGPVVDLKVRSVSKSSCSIGWKKPHSDGGSRIIGYVVDFLTEENKWQRVMKSLSLQYSAKDLTEGKEYTFRVSAENENGEGTPSEITVVARDDVVAPDLDLKGLPDLCYLAKENSNFRLKIPIKGKPAPSVSWKKGEDPLATDTRVSVESSAVNTTLIVYDCQKSDAGKYTITLKNVAGTKEGTISIKVVGKPGIPTGPIKFDEVTAEAMTLKWAPPKDDGGSEITNYILEKRDSVNNKWVTCASAVQKTTFRVTRLHEGMEYTFRVSAENKYGVGEGLKSEPIVARHPFDVPDAPPPPNIVDVRHDSVSLTWTDPKKTGGSPITGYHLEFKERNSLLWKRANKTPIRMRDFKVTGLTEGLEYEFRVMAINLAGVGKPSLPSEPVVALDPIDPPGKPEVINITRNSVTLIWTEPKYDGGHKLTGYIVEKRDLPSKSWMKANHVNVPECAFTVTDLVEGGKYEFRIRAKNTAGAISAPSESTETIICKDEYEAPTIVLDPTIKDGLTIKAGDTIVLNAISILGKPLPKSSWSKAGKDIRPSDITQITSTPTSSMLTIKYATRKDAGEYTITATNPFGTKVEHVKVTVLDVPGPPGPVEISNVSAEKATLTWTPPLEDGGSPIKSYILEKRETSRLLWTVVSEDIQSCRHVATKLIQGNEYIFRVSAVNHYGKGEPVQSEPVKMVDRFGPPGPPEKPEVSNVTKNTATVSWKRPVDDGGSEITGYHVERREKKSLRWVRAIKTPVSDLRCKVTGLQEGSTYEFRVSAENRAGIGPPSEASDSVLMKDAAYPPGPPSNPHVTDTTKKSASLAWGKPHYDGGLEITGYVVEHQKVGDEAWIKDTTGTALRITQFVVPDLQTKEKYNFRISAINDAGVGEPAVIPDVEIVEREMAPDFELDAELRRTLVVRAGLSIRIFVPIKGRPAPEVTWTKDNINLKNRANIENTESFTLLIIPECNRYDTGKFVMTIENPAGKKSGFVNVRVLDTPGPVLNLRPTDITKDSVTLHWDLPLIDGGSRITNYIVEKREATRKSYSTATTKCHKCTYKVTGLSEGCEYFFRVMAENEYGIGEPTETTEPVKASEAPSPPDSLNIMDITKSTVSLAWPKPKHDGGSKITGYVIEAQRKGSDQWTHITTVKGLECVVRNLTEGEEYTFQVMAVNSAGRSAPRESRPVIVKEQTMLPELDLRGIYQKLVIAKAGDNIKVEIPVLGRPKPTVTWKKGDQILKQTQRVNFETTATSTILNINECVRSDSGPYPLTARNIVGEVGDVITIQVHDIPGPPTGPIKFDEVSSDFVTFSWDPPENDGGVPISNYVVEMRQTDSTTWVELATTVIRTTYKATRLTTGLEYQFRVKAQNRYGVGPGITSACIVANYPFKVPGPPGTPQVTAVTKDSMTISWHEPLSDGGSPILGYHVERKERNGILWQTVSKALVPGNIFKSSGLTDGIAYEFRVIAENMAGKSKPSKPSEPMLALDPIDPPGKPVPLNITRHTVTLKWAKPEYTGGFKITSYIVEKRDLPNGRWLKANFSNILENEFTVSGLTEDAAYEFRVIAKNAAGAISPPSEPSDAITCRDDVEAPKIKVDVKFKDTVILKAGEAFRLEADVSGRPPPTMEWSKDGKELEGTAKLEIKIADFSTNLVNKDSTRRDSGAYTLTATNPGGFAKHIFNVKVLDRPGPPEGPLAVTEVTSEKCVLSWFPPLDDGGAKIDHYIVQKRETSRLAWTNVASEVQVTKLKVTKLLKGNEYIFRVMAVNKYGVGEPLESEPVLAVNPYGPPDPPKNPEVTTITKDSMVVCWGHPDSDGGSEIINYIVERRDKAGQRWIKCNKKTLTDLRYKVSGLTEGHEYEFRIMAENAAGISAPSPTSPFYKACDTVFKPGPPGNPRVLDTSRSSISIAWNKPIYDGGSEITGYMVEIALPEEDEWQIVTPPAGLKATSYTITGLTENQEYKIRIYAMNSEGLGEPALVPGTPKAEDRMLPPEIELDADLRKVVTIRACCTLRLFVPIKGRPAPEVKWARDHGESLDKASIESTSSYTLLIVGNVNRFDSGKYILTVENSSGSKSAFVNVRVLDTPGPPQDLKVKEVTKTSVTLTWDPPLLDGGSKIKNYIVEKRESTRKAYSTVATNCHKTSWKVDQLQEGCSYYFRVLAENEYGIGLPAETAESVKASERPLPPGKITLMDVTRNSVSLSWEKPEHDGGSRILGYIVEMQTKGSDKWATCATVKVTEATITGLIQGEEYSFRVSAQNEKGISDPRQLSVPVIAKDLVIPPAFKLLFNTFTVLAGEDLKVDVPFIGRPTPAVTWHKDNVPLKQTTRVNAESTENNSLLTIKDACREDVGHYVVKLTNSAGEAIETLNVIVLDKPGPPTGPVKMDEVTADSITLSWGPPKYDGGSSINNYIVEKRDTSTTTWQIVSATVARTTIKACRLKTGCEYQFRIAAENRYGKSTYLNSEPTVAQYPFKVPGPPGTPVVTLSSRDSMEVQWNEPISDGGSRVIGYHLERKERNSILWVKLNKTPIPQTKFKTTGLEEGVEYEFRVSAENIVGIGKPSKVSECYVARDPCDPPGRPEAIIVTRNSVTLQWKKPTYDGGSKITGYIVEKKELPEGRWMKASFTNIIDTHFEVTGLVEDHRYEFRVIARNAAGVFSEPSESTGAITARDEVDPPRISMDPKYKDTIVVHAGESFKVDADIYGKPIPTIQWIKGDQELSNTARLEIKSTDFATSLSVKDAVRVDSGNYILKAKNVAGERSVTVNVKVLDRPGPPEGPVVISGVTAEKCTLAWKPPLQDGGSDIINYIVERRETSRLVWTVVDANVQTLSCKVTKLLEGNEYTFRIMAVNKYGVGEPLESEPVVAKNPFVVPDAPKAPEVTTVTKDSMIVVWERPASDGGSEILGYVLEKRDKEGIRWTRCHKRLIGELRLRVTGLIENHDYEFRVSAENAAGLSEPSPPSAYQKACDPIYKPGPPNNPKVIDITRSSVFLSWSKPIYDGGCEIQGYIVEKCDVSVGEWTMCTPPTGINKTNIEVEKLLEKHEYNFRICAINKAGVGEHADVPGPIIVEEKLEAPDIDLDLELRKIINIRAGGSLRLFVPIKGRPTPEVKWGKVDGEIRDAAIIDVTSSFTSLVLDNVNRYDSGKYTLTLENSSGTKSAFVTVRVLDTPSPPVNLKVTEITKDSVSITWEPPLLDGGSKIKNYIVEKREATRKSYAAVVTNCHKNSWKIDQLQEGCSYYFRVTAENEYGIGLPAQTADPIKVAEVPQPPGKITVDDVTRNSVSLSWTKPEHDGGSKIIQYIVEMQAKHSEKWSECARVKSLQAVITNLTQGEEYLFRVVAVNEKGRSDPRSLAVPIVAKDLVIEPDVKPAFSSYSVQVGQDLKIEVPISGRPKPTITWTKDGLPLKQTTRINVTDSLDLTTLSIKETHKDDGGQYGITVANVVGQKTASIEIVTLDKPDPPKGPVKFDDVSAESITLSWNPPLYTGGCQITNYIVQKRDTTTTVWDVVSATVARTTLKVTKLKTGTEYQFRIFAENRYGQSFALESDPIVAQYPYKEPGPPGTPFATAISKDSMVIQWHEPVNNGGSPVIGYHLERKERNSILWTKVNKTIIHDTQFKAQNLEEGIEYEFRVYAENIVGVGKASKNSECYVARDPCDPPGTPEPIMVKRNEITLQWTKPVYDGGSMITGYIVEKRDLPDGRWMKASFTNVIETQFTVSGLTEDQRYEFRVIAKNAAGAISKPSDSTGPITAKDEVELPRISMDPKFRDTIVVNAGETFRLEADVHGKPLPTIEWLRGDKEIEESARCEIKNTDFKALLIVKDAIRIDGGQYILRASNVAGSKSFPVNVKVLDRPGPPEGPVQVTGVTSEKCSLTWSPPLQDGGSDISHYVVEKRETSRLAWTVVASEVVTNSLKVTKLLEGNEYVFRIMAVNKYGVGEPLESAPVLMKNPFVLPGPPKSLEVTNIAKDSMTVCWNRPDSDGGSEIIGYIVEKRDRSGIRWIKCNKRRITDLRLRVTGLTEDHEYEFRVSAENAAGVGEPSPATVYYKACDPVFKPGPPTNAHIVDTTKNSITLAWGKPIYDGGSEILGYVVEICKADEEEWQIVTPQTGLRVTRFEISKLTEHQEYKIRVCALNKVGLGEATSVPGTVKPEDKLEAPELDLDSELRKGIVVRAGGSARIHIPFKGRPTPEITWSREEGEFTDKVQIEKGVNYTQLSIDNCDRNDAGKYILKLENSSGSKSAFVTVKVLDTPGPPQNLAVKEVRKDSAFLVWEPPIIDGGAKVKNYVIDKRESTRKAYANVSSKCSKTSFKVENLTEGAIYYFRVMAENEFGVGVPVETVDAVKAAEPPSPPGKVTLTDVSQTSASLMWEKPEHDGGSRVLGYVVEMQPKGTEKWSIVAESKVCNAVVTGLSSGQEYQFRVKAYNEKGKSDPRVLGVPVIAKDLTIQPSLKLPFNTYSIQAGEDLKIEIPVIGRPRPNISWVKDGEPLKQTTRVNVEETATSTVLHIKEGNKDDFGKYTVTATNSAGTATENLSVIVLEKPGPPVGPVRFDEVSADFVVISWEPPAYTGGCQISNYIVEKRDTTTTTWHMVSATVARTTIKITKLKTGTEYQFRIFAENRYGKSAPLDSKAVIVQYPFKEPGPPGTPFVTSISKDQMLVQWHEPVNDGGTKIIGYHLEQKEKNSILWVKLNKTPIQDTKFKTTGLDEGLEYEFKVSAENIVGIGKPSKVSECFVARDPCDPPGRPEAIVITRNNVTLKWKKPAYDGGSKITGYIVEKKDLPDGRWMKASFTNVLETEFTVSGLVEDQRYEFRVIARNAAGNFSEPSDSSGAITARDEIDAPNASLDPKYKDVIVVHAGETFVLEADIRGKPIPDVVWSKDGKELEETAARMEIKSTIQKTTLVVKDCIRTDGGQYILKLSNVGGTKSIPITVKVLDRPGPPEGPLKVTGVTAEKCYLAWNPPLQDGGANISHYIIEKRETSRLSWTQVSTEVQALNYKVTKLLPGNEYIFRVMAVNKYGIGEPLESGPVTACNPYKPPGPPSTPEVSAITKDSMVVTWARPVDDGGTEIEGYILEKRDKEGVRWTKCNKKTLTDLRLRVTGLTEGHSYEFRVAAENAAGVGEPSEPSVFYRACDALYPPGPPSNPKVTDTSRSSVSLAWSKPIYDGGAPVKGYVVEVKEAAADEWTTCTPPTGLQGKQFTVTKLKENTEYNFRICAINSEGVGEPATLPGSVVAQERIEPPEIELDADLRKVVVLRASATLRLFVTIKGRPEPEVKWEKAEGILTDRAQIEVTSSFTMLVIDNVTRFDSGRYNLTLENNSGSKTAFVNVRVLDSPSAPVNLTIREVKKDSVTLSWEPPLIDGGAKITNYIVEKRETTRKAYATITNNCTKTTFRIENLQEGCSYYFRVLASNEYGIGLPAETTEPVKVSEPPLPPGRVTLVDVTRNTATIKWEKPESDGGSKITGYVVEMQTKGSEKWSTCTQVKTLEATISGLTAGEEYVFRVAAVNEKGRSDPRQLGVPVIARDIEIKPSVELPFHTFNVKAREQLKIDVPFKGRPQATVNWRKDGQTLKETTRVNVSSSKTVTSLSIKEASKEDVGTYELCVSNSAGSITVPITIIVLDRPGPPGPIRIDEVSCDSITISWNPPEYDGGCQISNYIVEKKETTSTTWHIVSQAVARTSIKIVRLTTGSEYQFRVCAENRYGKSSYSESSAVVAEYPFSPPGPPGTPKVVHATKSTMLVTWQVPVNDGGSRVIGYHLEYKERSSILWSKANKILIADTQMKVSGLDEGLMYEYRVYAENIAGIGKCSKSCEPVPARDPCDPPGQPEVTNITRKSVSLKWSKPHYDGGAKITGYIVERRELPDGRWLKCNYTNIQETYFEVTELTEDQRYEFRVFARNAADSVSEPSESTGPIIVKDDVEPPRVMMDVKFRDVIVVKAGEVLKINADIAGRPLPVISWAKDGIEIEERARTEIISTDNHTLLTVKDCIRRDTGQYVLTLKNVAGTRSVAVNCKVLDKPGPPAGPLEINGLTAEKCSLSWGRPQEDGGADIDYYIVEKRETSHLAWTICEGELQMTSCKVTKLLKGNEYIFRVTGVNKYGVGEPLESVAIKALDPFTVPSPPTSLEITSVTKESMTLCWSRPESDGGSEISGYIIERREKNSLRWVRVNKKPVYDLRVKSTGLREGCEYEYRVYAENAAGLSLPSETSPLIRAEDPVFLPSPPSKPKIVDSGKTTITIAWVKPLFDGGAPITGYTVEYKKSDDTDWKTSIQSLRGTEYTISGLTTGAEYVFRVKSVNKVGASDPSDSSDPQIAKEREEEPLFDIDSEMRKTLIVKAGASFTMTVPFRGRPVPNVLWSKPDTDLRTRAYVDTTDSRTSLTIENANRNDSGKYTLTIQNVLSAASLTLVVKVLDTPGPPTNITVQDVTKESAVLSWDVPENDGGAPVKNYHIEKREASKKAWVSVTNNCNRLSYKVTNLQEGAIYYFRVSGENEFGVGIPAETKEGVKITEKPSPPEKLGVTSISKDSVSLTWLKPEHDGGSRIVHYVVEALEKGQKNWVKCAVAKSTHHVVSGLRENSEYFFRVFAENQAGLSDPRELLLPVLIKEQLEPPEIDMKNFPSHTVYVRAGSNLKVDIPISGKPLPKVTLSRDGVPLKATMRFNTEITAENLTINLKESVTADAGRYEITAANSSGTTKAFINIVVLDRPGPPTGPVVISDITEESVTLKWEPPKYDGGSQVTNYILLKRETSTAVWTEVSATVARTMMKVMKLTTGEEYQFRIKAENRFGISDHIDSACVTVKLPYTTPGPPSTPWVTNVTRESITVGWHEPVSNGGSAVVGYHLEMKDRNSILWQKANKLVIRTTHFKVTTISAGLIYEFRVYAENAAGVGKPSHPSEPVLAIDACEPPRNVRITDISKNSVSLSWQQPAFDGGSKITGYIVERRDLPDGRWTKASFTNVTETQFIISGLTQNSQYEFRVFARNAVGSISNPSEVVGPITCIDSYGGPVIDLPLEYTEVVKYRAGTSVKLRAGISGKPAPTIEWYKDDKELQTNALVCVENTTDLASILIKDADRLNSGCYELKLRNAMGSASATIRVQILDKPGPPGGPIEFKTVTAEKITLLWRPPADDGGAKITHYIVEKRETSRVVWSMVSEHLEECIITTTKIIKGNEYIFRVRAVNKYGIGEPLESDSVVAKNAFVTPGPPGIPEVTKITKNSMTVVWSRPIADGGSDISGYFLEKRDKKSLGWFKVLKETIRDTRQKVTGLTENSDYQYRVCAVNAAGQGPFSEPSEFYKAADPIDPPGPPAKIRIADSTKSSITLGWSKPVYDGGSAVTGYVVEIRQGEEEEWTTVSTKGEVRTTEYVVSNLKPGVNYYFRVSAVNCAGQGEPIEMNEPVQAKDILEAPEIDLDVALRTSVIAKAGEDVQVLIPFKGRPPPTVTWRKDEKNLGSDARYSIENTDSSSLLTIPQVTRNDTGKYILTIENGVGEPKSSTVSVKVLDTPAACQKLQVKHVSRGTVTLLWDPPLIDGGSPIINYVIEKRDATKRTWSVVSHKCSSTSFKLIDLSEKTPFFFRVLAENEIGIGEPCETTEPVKAAEVPAPIRDLSMKDSTKTSVILSWTKPDFDGGSVITEYVVERKGKGEQTWSHAGISKTCEIEVSQLKEQSVLEFRVFAKNEKGLSDPVTIGPITVKELIITPEVDLSDIPGAQVTVRIGHNVHLELPYKGKPKPSISWLKDGLPLKESEFVRFSKTENKITLSIKNAKKEHGGKYTVILDNAVCRIAVPITVITLGPPSKPKGPIRFDEIKADSVILSWDVPEDNGGGEITCYSIEKRETSQTNWKMVCSSVARTTFKVPNLVKDAEYQFRVRAENRYGVSQPLVSSIIVAKHQFRIPGPPGKPVIYNVTSDGMSLTWDAPVYDGGSEVTGFHVEKKERNSILWQKVNTSPISGREYRATGLVEGLDYQFRVYAENSAGLSSPSDPSKFTLAVSPVDPPGTPDYIDVTRETITLKWNPPLRDGGSKIVGYSIEKRQGNERWVRCNFTDVSECQYTVTGLSPGDRYEFRIIARNAVGTISPPSQSSGIIMTRDENVPPIVEFGPEYFDGLIIKSGESLRIKALVQGRPVPRVTWFKDGVEIEKRMNMEITDVLGSTSLFVRDATRDHRGVYTVEAKNASGSAKAEIKVKVQDTPGKVVGPIRFTNITGEKMTLWWDAPLNDGCAPITHYIIEKRETSRLAWALIEDKCEAQSYTAIKLINGNEYQFRVSAVNKFGVGRPLDSDPVVAQIQYTVPDAPGIPEPSNITGNSITLTWARPESDGGSEIQQYILERREKKSTRWVKVISKRPISETRFKVTGLTEGNEYEFHVMAENAAGVGPASGISRLIKCREPVNPPGPPTVVKVTDTSKTTVSLEWSKPVFDGGMEIIGYIIEMCKADLGDWHKVNAEACVKTRYTVTDLQAGEEYKFRVSAINGAGKGDSCEVTGTIKAVDRLTAPELDIDANFKQTHVVRAGASIRLFIAYQGRPTPTAVWSKPDSNLSLRADIHTTDSFSTLTVENCNRNDAGKYTLTVENNSGSKSITFTVKVLDTPGPPGPITFKDVTRGSATLMWDAPLLDGGARIHHYVVEKREASRRSWQVISEKCTRQIFKVNDLAEGVPYYFRVSAVNEYGVGEPYEMPEPIVATEQPAPPRRLDVVDTSKSSAVLAWLKPDHDGGSRITGYLLEMRQKGSDFWVEAGHTKQLTFTVERLVEKTEYEFRVKAKNDAGYSEPREAFSSVIIKEPQIEPTADLTGITNQLITCKAGSPFTIDVPISGRPAPKVTWKLEEMRLKETDRVSITTTKDRTTLTVKDSMRGDSGRYFLTLENTAGVKTFSVTVVVIGRPGPVTGPIEVSSVSAESCVLSWGEPKDGGGTEITNYIVEKRESGTTAWQLVNSSVKRTQIKVTHLTKYMEYSFRVSSENRFGVSKPLESAPIIAEHPFVPPSAPTRPEVYHVSANAMSIRWEEPYHDGGSKIIGYWVEKKERNTILWVKENKVPCLECNYKVTGLVEGLEYQFRTYALNAAGVSKASEASRPIMAQNPVDAPGRPEVTDVTRSTVSLIWSAPAYDGGSKVVGYIIERKPVSEVGDGRWLKCNYTIVSDNFFTVTALSEGDTYEFRVLAKNAAGVISKGSESTGPVTCRDEYAPPKAELDARLHGDLVTIRAGSDLVLDAAVGGKPEPKIIWTKGDKELDLCEKVSLQYTGKRATAVIKFCDRSDSGKYTLTVKNASGTKAVSVMVKVLDSPGPCGKLTVSRVTQEKCTLAWSLPQEDGGAEITHYIVERRETSRLNWVIVEGECPTLSYVVTRLIKNNEYIFRVRAVNKYGPGVPVESEPIVARNSFTIPSPPGIPEEVGTGKEHIIIQWTKPESDGGNEISNYLVDKREKKSLRWTRVNKDYVVYDTRLKVTSLMEGCDYQFRVTAVNAAGNSEPSEASNFISCREPSYTPGPPSAPRVVDTTKHSISLAWTKPMYDGGTDIVGYVLEMQEKDTDQWYRVHTNATIRNTEFTVPDLKMGQKYSFRVAAVNVKGMSEYSESIAEIEPVERIEIPDLELADDLKKTVTIRAGASLRLMVSVSGRPPPVITWSKQGIDLASRAIIDTTESYSLLIVDKVNRYDAGKYTIEAENQSGKKSATVLVKVYDTPGPCPSVKVKEVSRDSVTITWEIPTIDGGAPVNNYIVEKREAAMRAFKTVTTKCSKTLYRISGLVEGTMYYFRVLPENIYGIGEPCETSDAVLVSEVPLVPAKLEVVDVTKSTVTLAWEKPLYDGGSRLTGYVLEACKAGTERWMKVVTLKPTVLEHTVTSLNEGEQYLFRIRAQNEKGVSEPRETVTAVTVQDLRVLPTIDLSTMPQKTIHVPAGRPVELVIPIAGRPPPAASWFFAGSKLRESERVTVETHTKVAKLTIRETTIRDTGEYTLELKNVTGTTSETIKVIILDKPGPPTGPIKIDEIDATSITISWEPPELDGGAPLSGYVVEQRDAHRPGWLPVSESVTRSTFKFTRLTEGNEYVFRVAATNRFGIGSYLQSEVIECRSSIRIPGPPETLQIFDVSRDGMTLTWYPPEDDGGSQVTGYIVERKEVRADRWVRVNKVPVTMTRYRSTGLTEGLEYEHRVTAINARGSGKPSRPSKPIVAMDPIAPPGKPQNPRVTDTTRTSVSLAWSVPEDEGGSKVTGYLIEMQKVDQHEWTKCNTTPTKIREYTLTHLPQGAEYRFRVLACNAGGPGEPAEVPGTVKVTEMLEYPDYELDERYQEGIFVRQGGVIRLTIPIKGKPFPICKWTKEGQDISKRAMIATSETHTELVIKEADRGDSGTYDLVLENKCGKKAVYIKVRVIGSPNSPEGPLEYDDIQVRSVRVSWRPPADDGGADILGYILERREVPKAAWYTIDSRVRGTSLVVKGLKENVEYHFRVSAENQFGISKPLKSEEPVTPKTPLNPPEPPSNPPEVLDVTKSSVSLSWSRPKDDGGSRVTGYYIERKETSTDKWVRHNKTQITTTMYTVTGLVPDAEYQFRIIAQNDVGLSETSPASEPVVCKDPFDKPSQPGELEILSISKDSVTLQWEKPECDGGKEILGYWVEYRQSGDSAWKKSNKERIKDKQFTIGGLLEATEYEFRVFAENETGLSRPRRTAMSIKTKLTSGEAPGIRKEMKDVTTKLGEAAQLSCQIVGRPLPDIKWYRFGKELIQSRKYKMSSDGRTHTLTVMTEEQEDEGVYTCIATNEVGEVETSSKLLLQATPQFHPGYPLKEKYYGAVGSTLRLHVMYIGRPVPAMTWFHGQKLLQNSENITIENTEHYTHLVMKNVQRKTHAGKYKVQLSNVFGTVDAILDVEIQDKPDKPTGPIVIEALLKNSAVISWKPPADDGGSWITNYVVEKCEAKEGAEWQLVSSAISVTTCRIVNLTENAGYYFRVSAQNTFGISDPLEVSSVVIIKSPFEKPGAPGKPTITAVTKDSCVVAWKPPASDGGAKIRNYYLEKREKKQNKWISVTTEEIRETVFSVKNLIEGLEYEFRVKCENLGGESEWSEISEPITPKSDVPIQAPHFKEELRNLNVRYQSNATLVCKVTGHPKPIVKWYRQGKEIIADGLKYRIQEFKGGYHQLIIASVTDDDATVYQVRATNQGGSVSGTASLEVEVPAKIHLPKTLEGMGAVHALRGEVVSIKIPFSGKPDPVITWQKGQDLIDNNGHYQVIVTRSFTSLVFPNGVERKDAGFYVVCAKNRFGIDQKTVELDVADVPDPPRGVKVSDVSRDSVNLTWTEPASDGGSKITNYIVEKCATTAERWLRVGQARETRYTVINLFGKTSYQFRVIAENKFGLSKPSEPSEPTITKEDKTRAMNYDEEVDETREVSMTKASHSSTKELYEKYMIAEDLGRGEFGIVHRCVETSSKKTYMAKFVKVKGTDQVLVKKEISILNIARHRNILHLHESFESMEELVMIFEFISGLDIFERINTSAFELNEREIVSYVHQVCEALQFLHSHNIGHFDIRPENIIYQTRRSSTIKIIEFGQARQLKPGDNFRLLFTAPEYYAPEVHQHDVVSTATDMWSLGTLVYVLLSGINPFLAETNQQIIENIMNAEYTFDEEAFKEISIEAMDFVDRLLVKERKSRMTASEALQHPWLKQKIERVSTKVIRTLKHRRYYHTLIKKDLNMVVSAARISCGGAIRSQKGVSVAKVKVASIEIGPVSGQ

SEQ ID NO: 726 - DNA, 31 bp, Artificial Sequence
  Description of Artificial Sequence: Synthetic primer
caatcacaggatactgggttgaaagactgga

SEQ ID NO: 727 - DNA, 13 bp, Artificial Sequence
  Description of Artificial Sequence: Synthetic oligonucleotide
ggtttatctatct

What is claimed is:

1. A method of treating a subject for dilated cardiomyopathy (DCM), comprising:
   a. Selecting a subject in need of treatment for DCM using an assay comprising:
      i. contacting a nucleic acid sample obtained from a subject with a probe, wherein the probe is capable of detecting a mutation resulting in a truncated TITIN polypeptide;
      ii. detecting the presence of the mutation in the nucleic acid sample, and
   b. administering a treatment for DCM if at least one mutation is detected in (ii);
      wherein the mutation is selected from the group consisting of 6247_6247delG, 12745C>T, 14470_14471insCACACTCCATA (SEQ ID NO: 722), 19183_19183delG, 23798_23810delGTCAAGATATCTG (SEQ ID NO: 723), 38621_38622insA, 44336_44336delA, 45322_45322delT, 49077G>A, 51883C>T, 52408C>T, 53145_53146insG, 53347G>T, 53935_53935delC, 56367T>A, 56572C>T, 56953C>T, 58678C>T, 59530C>T, 61046_61046delC, 65867_65867delA, 67057_67063delGCATATGinsTA, 67745_67745delT, 72178_72179insT, 72723_72739delinsAGA, 77065C>T, 79896G>A, 80845C>T, 81046A>T, 81440G>A, 81536_81537delCT, 82701C>A, 84977_84980delATTA, 87953G>A, 88242C>T, 88528G>T, 89177_89181delAAATT, 90241C>T, 91042_91042delA, 91537_91538insA, 94111A>T, 95522C>A, 30476-1G>A, 34186+1G>T, 35635G>C, 35635+1G>A, 44725+2delT, 48364+1G>T, 50346_+3A>G, 54422-5T>A, 54704-1G>A, 55003+1G>A, 62425+5G>A, 63405A>G, 64489+1G>A, 81898+2T>A, 92569+1G>C, and any combination thereof, wherein the mutation location is determined based upon the wildtype TTN sequence having a nucleic acid sequence set forth in SEQ ID NO: 1.

2. The method of claim 1, wherein the treatment is selected from the group consisting of angiotensin-converting enzyme (ACE) inhibitors, angiotensin II receptor blockers, beta blockers, diuretics, aldosterone antagonists, digoxin (Lanoxin), blood thinning medications, biventricular pacemakers, implantable cardioverter-defibrillators (ICDs), heart pumps (left ventricular assist devices, or LVADs), heart transplant, calcium channel blockers, tissue growth factor inhibitors, and any combinations thereof.

3. The method of claim 1, wherein the truncated TITIN polypeptide lacks part of the A-band, having a wild-type sequence set forth in SEQ ID NO: 725.

4. The method of claim 1, wherein detection of the mutation is by nucleic acid sequencing.

5. The method of claim 1, wherein dilated cardiomyopathy is idiopathic dilated cardiomyopathy.

6. A method of treating a subject for dilated cardiomyopathy (DCM), comprising administering a treatment for DCM to a subject determined to have a mutation selected from the group consisting of 6247_6247delG, 12745C>T, 14470_14471insCACACTCCATA (SEQ ID NO: 722), 19183_19183delG, 23798_23810delGTCAAGATATCTG (SEQ ID NO: 723), 38621_38622insA, 44336_44336delA, 45322_45322delT, 49077G>A, 51883C>T, 52408C>T, 53145_53146insG, 53347G>T, 53935_53935delC, 56367T>A, 56572C>T, 56953C>T, 58678C>T, 59530C>T, 61046_61046delC, 65867_65867delA, 67057_67063 delGCATATGinsTA, 67745_67745delT, 72178_72179insT, 72723_72739delinsAGA, 77065C>T, 79896G>A, 80845C>T, 81046A>T, 81440G>A, 81536_81537delCT, 82701C>A, 84977_84980delATTA, 87953G>A, 88242C>T, 88528G>T, 89177_89181delAAATT, 90241C>T, 91042_91042delA, 91537_91538insA, 94111A>T, 95522C>A, 30476-1G>A, 34186+1G>T, 35635G>C, 35635+1G>A, 44725+2delT, 48364+1G>T, 50346_+3A>G, 54422-5T>A, 54704-1G>A, 55003+1G>A, 62425+5G>A, 63405A>G, 64489+1G>A, 81898+2T>A, 92569+1G>C, and any combination thereof, wherein the mutation location is determined based upon the wildtype TTN sequence having a nucleic acid sequence set forth in SEQ ID NO: 1;

and not administering a treatment for DCM to a subject determined not to have a mutation selected from the group consisting of 6247_6247delG, 12745C>T, 14470_14471insCACACTCCATA (SEQ ID NO: 722), 19183_19183delG, 23798_23810delGTCAAGATATCTG (SEQ ID NO: 723), 38621_38622insA, 44336_44336delA, 45322_45322delT, 49077G>A, 51883C>T, 52408C>T, 53145_53146insG, 53347G>T, 53935_53935delC, 56367T>A, 56572C>T, 56953C>T, 58678C>T, 59530C>T, 61046_61046delC, 65867_65867delA, 67057_67063 delGCATATGinsTA, 67745_67745delT, 72178_72179insT, 72723_72739delinsAGA, 77065C>T, 79896G>A, 80845C>T, 81046A>T, 81440G>A, 81536_81537delCT, 82701C>A, 84977_84980delATTA, 87953G>A, 88242C>T, 88528G>T, 89177_89181delAAATT, 90241C>T, 91042_91042delA, 91537_91538insA, 94111A>T, 95522C>A, 30476-1G>A, 34186+1G>T, 35635G>C, 35635+1G>A, 44725+2delT, 48364+1G>T, 50346_+3A>G, 54422-5T>A, 54704-1G>A, 55003+1G>A, 62425+5G>A, 63405A>G, 64489+1G>A, 81898+2T>A, 92569+1G>C, and any combination thereof, wherein the mutation location is determined based upon the wildtype TTN sequence having a nucleic acid sequence set forth in SEQ ID NO: 1.

* * * * *